US011987823B2

United States Patent
Chng et al.

(10) Patent No.: US 11,987,823 B2
(45) Date of Patent: May 21, 2024

(54) ENGINEERED LIPASE VARIANTS

(71) Applicant: Societe des Produits Nestle S.A., Vevey (CH)

(72) Inventors: Chinping Chng, Menlo Park, CA (US); William Casey Hallows, San Francisco, CA (US); Judy Victoria Antonio Viduya, South San Francisco, CA (US); Nikki Dellas, San Carlos, CA (US); Stephanie Sue Galanie, Knoxville, TN (US); Kristen Jean Vallieu, Union City, CA (US)

(73) Assignee: Societe des Produits Nestle S.A., Vevey (CH)

( * ) Notice: Subject to any disclaimer, the term of this patent is extended or adjusted under 35 U.S.C. 154(b) by 264 days.

(21) Appl. No.: 17/005,913

(22) Filed: Aug. 28, 2020

(65) Prior Publication Data

US 2021/0062168 A1   Mar. 4, 2021

Related U.S. Application Data

(60) Provisional application No. 62/894,019, filed on Aug. 30, 2019.

(51) Int. Cl.
| | |
|---|---|
| *C12N 9/20* | (2006.01) |
| *A61K 9/48* | (2006.01) |
| *A61K 38/46* | (2006.01) |
| *A61P 5/48* | (2006.01) |

(52) U.S. Cl.
CPC ............. *C12N 9/20* (2013.01); *A61K 9/4883* (2013.01); *A61K 38/465* (2013.01); *A61P 5/48* (2018.01)

(58) Field of Classification Search
CPC ........ C12N 9/20; C12N 15/52; A61K 9/4883; A61K 38/465; A61K 9/0056; A61P 5/48; Y02E 50/10; A23L 33/10
See application file for complete search history.

(56) References Cited

U.S. PATENT DOCUMENTS

| | | | |
|---|---|---|---|
| 5,605,793 A | 2/1997 | Stemmer | |
| 5,811,238 A | 9/1998 | Stemmer et al. | |
| 5,830,721 A | 11/1998 | Stemmer et al. | |
| 5,834,252 A | 11/1998 | Stemmer et al. | |
| 5,837,458 A | 11/1998 | Minshull et al. | |
| 5,928,905 A | 7/1999 | Stemmer et al. | |
| 6,096,548 A | 8/2000 | Stemmer | |
| 6,117,679 A | 9/2000 | Stemmer | |
| 6,132,970 A | 10/2000 | Stemmer | |
| 6,165,793 A | 12/2000 | Stemmer | |
| 6,180,406 B1 | 1/2001 | Stemmer | |
| 6,251,674 B1 | 6/2001 | Tobin et al. | |
| 6,265,201 B1 | 7/2001 | Wackett et al. | |
| 6,277,638 B1 | 8/2001 | Stemmer | |
| 6,287,861 B1 | 9/2001 | Stemmer et al. | |
| 6,287,862 B1 | 9/2001 | delCardayre et al. | |
| 6,291,242 B1 | 9/2001 | Stemmer | |
| 6,297,053 B1 | 10/2001 | Stemmer | |
| 6,303,344 B1 | 10/2001 | Patten et al. | |
| 6,309,883 B1 | 10/2001 | Minshull et al. | |
| 6,319,713 B1 | 11/2001 | Patten et al. | |
| 6,319,714 B1 | 11/2001 | Crameri et al. | |
| 6,323,030 B1 | 11/2001 | Stemmer | |
| 6,326,204 B1 | 12/2001 | delCardayre et al. | |
| 6,335,160 B1 | 1/2002 | Patten et al. | |
| 6,335,198 B1 | 1/2002 | delCardayre et al. | |
| 6,337,186 B1 | 1/2002 | Krebber | |
| 6,344,356 B1 | 2/2002 | Stemmer | |
| 6,352,859 B1 | 3/2002 | delCardayre et al. | |
| 6,355,484 B1 | 3/2002 | Patten et al. | |
| 6,358,740 B1 | 3/2002 | Patten et al. | |
| 6,358,742 B1 | 3/2002 | Stemmer | |
| 6,365,377 B1 | 4/2002 | Patten et al. | |
| 6,365,408 B1 | 4/2002 | Stemmer | |
| 6,368,861 B1 | 4/2002 | Crameri et al. | |
| 6,372,497 B1 | 4/2002 | Stemmer | |
| 6,376,246 B1 | 4/2002 | Crameri et al. | |

(Continued)

FOREIGN PATENT DOCUMENTS

| | | |
|---|---|---|
| CN | 104955944 A | 9/2015 |
| EP | 1261368 B1 | 4/2010 |

(Continued)

OTHER PUBLICATIONS

Thumarat, Uschara. Identification, gene cloning and characterization of an extremely thermoactive and thermotolerant lipase from Bacillus thermoamylovorans BHK52. Diss. Prince of Songkla University, 2008. (Year: 2008).*

Deive, Francisco J., et al. "A process for extracellular thermostable lipase production by a novel Bacillus thermoamylovorans strain." Bioprocess and biosystems engineering 35.6 (2012): 931-941. (Year: 2012).*

Zdenkowski, Nicholas, et al. "Treatment of pancreatic insufficiency using pancreatic extract in patients with advanced pancreatic cancer: A pilot study (PICNIC)." Supportive Care in Cancer 25.6 (2017): 1963-1971. (Year: 2017).*

(Continued)

*Primary Examiner* — Louise W Humphrey
*Assistant Examiner* — Candice Lee Swift
(74) *Attorney, Agent, or Firm* — K&L Gates LLP

(57) ABSTRACT

The present invention provides engineered lipase polypeptides and compositions thereof. The engineered lipase polypeptides have been optimized to provide improved thermostability, protease stability, and stability under a range of pH conditions, including acidic (pH<7) and basic (pH>7) conditions. The invention also relates to the use of the compositions comprising the engineered lipase polypeptides for therapeutic and/or nutritional purposes. The present invention also provides polynucleotides encoding the engineered lipase polypeptides, as well as methods for making the engineered polynucleotides and lipase polypeptides.

48 Claims, No Drawings

Specification includes a Sequence Listing.

(56) References Cited

U.S. PATENT DOCUMENTS

| | | |
|---|---|---|
| 6,379,964 B1 | 4/2002 | delCardayre et al. |
| 6,387,702 B1 | 5/2002 | Stemmer |
| 6,391,552 B2 | 5/2002 | Stemmer |
| 6,391,640 B1 | 5/2002 | Minshull et al. |
| 6,395,547 B1 | 5/2002 | Stemmer |
| 6,406,855 B1 | 6/2002 | Patten et al. |
| 6,406,910 B1 | 6/2002 | Patten et al. |
| 6,413,745 B1 | 7/2002 | Patten et al. |
| 6,413,774 B1 | 7/2002 | Stemmer |
| 6,420,175 B1 | 7/2002 | Stemmer |
| 6,423,542 B1 | 7/2002 | Crameri et al. |
| 6,426,224 B1 | 7/2002 | Crameri et al. |
| 6,436,675 B1 | 8/2002 | Welch et al. |
| 6,444,468 B1 | 9/2002 | Stemmer et al. |
| 6,455,253 B1 | 9/2002 | Patten et al. |
| 6,479,652 B1 | 11/2002 | Crameri et al. |
| 6,482,647 B1 | 11/2002 | Stemmer |
| 6,483,011 B1 | 11/2002 | Stemmer et al. |
| 6,484,105 B2 | 11/2002 | Zhang |
| 6,489,146 B2 | 12/2002 | Stemmer et al. |
| 6,500,617 B1 | 12/2002 | Stemmer et al. |
| 6,500,639 B2 | 12/2002 | Subramanian |
| 6,506,602 B1 | 1/2003 | Stemmer |
| 6,506,603 B1 | 1/2003 | Stemmer |
| 6,518,065 B1 | 2/2003 | Stemmer |
| 6,519,065 B1 | 2/2003 | Colbourne et al. |
| 6,521,453 B1 | 2/2003 | Crameri et al. |
| 6,528,311 B1 | 3/2003 | delCardayre et al. |
| 6,537,746 B2 | 3/2003 | Arnold et al. |
| 6,573,098 B1 | 6/2003 | Stemmer |
| 6,576,467 B1 | 6/2003 | Stemmer |
| 6,579,678 B1 | 6/2003 | Patten et al. |
| 6,586,182 B1 | 7/2003 | Patten et al. |
| 6,602,986 B1 | 8/2003 | Stemmer et al. |
| 6,605,430 B1 | 8/2003 | Affholter et al. |
| 6,613,514 B2 | 9/2003 | Patten et al. |
| 6,653,072 B1 | 11/2003 | Patten et al. |
| 6,686,515 B1 | 2/2004 | Lassner et al. |
| 6,703,240 B1 | 3/2004 | Stemmer et al. |
| 6,716,631 B1 | 4/2004 | delCardayre et al. |
| 6,825,001 B2 | 11/2004 | Wackett et al. |
| 6,902,922 B2 | 6/2005 | Ness et al. |
| 6,917,882 B2 | 7/2005 | Selfinov et al. |
| 6,946,296 B2 | 9/2005 | Patten et al. |
| 6,961,664 B2 | 11/2005 | Selfinov et al. |
| 6,995,017 B1 | 2/2006 | Stemmer |
| 7,024,312 B1 | 4/2006 | Selfinov et al. |
| 7,058,515 B1 | 6/2006 | Selfinov et al. |
| 7,105,297 B2 | 9/2006 | Minshull et al. |
| 7,148,054 B2 | 12/2006 | delCardayre et al. |
| 7,220,566 B2 | 5/2007 | Ness et al. |
| 7,288,375 B2 | 10/2007 | Stemmer et al. |
| 7,384,387 B1 | 6/2008 | Raillard et al. |
| 7,421,347 B2 | 9/2008 | Selfinov et al. |
| 7,430,477 B2 | 9/2008 | Selfinov et al. |
| 7,462,469 B2 | 12/2008 | Bass et al. |
| 7,531,341 B1 | 5/2009 | Vellard et al. |
| 7,534,564 B2 | 5/2009 | Patten et al. |
| 7,534,595 B2 | 5/2009 | Vellard et al. |
| 7,560,263 B2 | 7/2009 | Kakkis et al. |
| 7,620,500 B2 | 11/2009 | Mundorff et al. |
| 7,620,502 B2 | 11/2009 | Selfinov et al. |
| 7,629,157 B2 | 12/2009 | Davis et al. |
| 7,629,170 B2 | 12/2009 | delCardayre et al. |
| 7,702,464 B1 | 4/2010 | Emig et al. |
| 7,718,169 B2 | 5/2010 | Margolin et al. |
| 7,747,391 B2 | 6/2010 | Gustafsson et al. |
| 7,747,393 B2 | 6/2010 | Fox |
| 7,751,986 B2 | 7/2010 | Gustafsson et al. |
| 7,776,598 B2 | 8/2010 | Patten et al. |
| 7,783,428 B2 | 8/2010 | Gustafsson et al. |
| 7,795,030 B2 | 9/2010 | Minshull et al. |
| 7,853,410 B2 | 12/2010 | Selfinov et al. |
| 7,868,138 B2 | 1/2011 | Stemmer et al. |
| 7,873,477 B1 | 1/2011 | Gustafsson et al. |
| 7,873,499 B2 | 1/2011 | Selfinov et al. |
| 7,904,249 B2 | 3/2011 | Selfinov et al. |
| 7,957,912 B2 | 6/2011 | Selfinov et al. |
| 7,981,614 B2 | 7/2011 | Stemmer et al. |
| 8,014,961 B2 | 9/2011 | Bass et al. |
| 8,029,988 B2 | 10/2011 | Crameri et al. |
| 8,048,674 B2 | 11/2011 | Minshull et al. |
| 8,058,001 B2 | 11/2011 | Crameri et al. |
| 8,076,138 B2 | 12/2011 | delCardayre et al. |
| 8,108,150 B2 | 1/2012 | Mundorff et al. |
| 8,170,806 B2 | 5/2012 | Selfinov et al. |
| 8,224,580 B2 | 7/2012 | Mundorff et al. |
| 8,377,681 B2 | 2/2013 | delCardayre et al. |
| 8,383,346 B2 | 2/2013 | Colbeck et al. |
| 8,457,903 B1 | 6/2013 | Emig et al. |
| 8,504,498 B2 | 8/2013 | Fox |
| 8,589,085 B2 | 11/2013 | Selfinov et al. |
| 8,762,066 B2 | 6/2014 | Fox |
| 8,768,871 B2 | 7/2014 | Fox |
| 8,834,867 B2 | 9/2014 | Leblond et al. |
| 8,849,575 B2 | 9/2014 | Gustafsson et al. |
| 9,593,326 B2 | 3/2017 | Clark et al. |
| 9,665,694 B2 | 5/2017 | Cope |
| 9,684,771 B2 | 6/2017 | Cope et al. |
| 9,714,437 B2 | 7/2017 | Chan et al. |
| 9,803,224 B2 | 10/2017 | Chan et al. |
| 9,864,833 B2 | 1/2018 | Fox |
| 9,996,661 B2 | 6/2018 | Gustafsson et al. |
| 10,308,920 B2 | 6/2019 | Bornscheuer et al. |
| 10,738,286 B2 | 8/2020 | Miller et al. |
| 2001/0046493 A1 | 11/2001 | Margolin et al. |
| 2003/0096390 A1 | 5/2003 | Giver et al. |
| 2005/0196834 A1 | 9/2005 | Rao et al. |
| 2006/0195947 A1 | 8/2006 | Davis et al. |
| 2008/0220990 A1 | 9/2008 | Fox |
| 2009/0312196 A1 | 12/2009 | Colbeck et al. |
| 2012/0177722 A1 | 7/2012 | Weiner et al. |
| 2013/0039898 A1 | 2/2013 | Okhamafe et al. |
| 2013/0052180 A1 | 2/2013 | Leblond et al. |
| 2016/0287679 A1 | 10/2016 | Ramsch et al. |
| 2018/0236040 A1 | 8/2018 | Forssmann |

FOREIGN PATENT DOCUMENTS

| | | |
|---|---|---|
| EP | 2450458 A2 | 5/2012 |
| RU | 2140983 C1 | 11/1999 |
| WO | 95/22625 A1 | 8/1995 |
| WO | 96/00787 A1 | 1/1996 |
| WO | 97/0078 A1 | 1/1997 |
| WO | 97/35966 A1 | 10/1997 |
| WO | 98/27230 A1 | 6/1998 |
| WO | 2000/42651 A1 | 7/2000 |
| WO | 2001/75767 A2 | 10/2001 |
| WO | 2009/152336 A1 | 12/2009 |
| WO | 2010/144103 A1 | 12/2010 |
| WO | 2016/105889 A1 | 6/2016 |
| WO | WO2019/185612 | 10/2019 |

OTHER PUBLICATIONS

Bittner, Beate, Wolfgang Richter, and Johannes Schmidt. "Subcutaneous administration of biotherapeutics: an overview of current challenges and opportunities." BioDrugs 32.5 (2018): 425-440. (Year: 2018).*

NCBI Reference Sequence WP_108898452.1; https://www.ncbi.nlm.nih.gov/protein/WP_108898452.1?report=genbank&log$=protalign&blast_rank=2&RID=KXGYGN6J016; accessed Oct. 6, 2022 (Year: 2018).*

NCBI Reference Sequence WP_041902890.1; https://www.ncbi.nlm.nih.gov/protein/WP_041902890.1?report=genbank&log$=protalign&blast_rank=5&RID=M06V7XF7013; accessed Oct. 7, 2022 (Year: 2018).*

NCBI taxonomy browser; https://www.ncbi.nlm.nih.gov/Taxonomy/Browser/wwwtax.cgi?mode=Info&id=35841&lvl=3&lin=f&keep=1&srchmode=1&unlock; accessed Oct. 6, 2022 (Year: 2022).*

(56) References Cited

OTHER PUBLICATIONS

NCBI structures database; https://www.ncbi.nlm.nih.gov/structure/?term=bacillus+thermoamylovorans; accessed Oct. 14, 2022 (Year: 2022).*
Aloulou, A., et al., "Purification and biochemical characterization of the LIP2 lipase from Yarrowia lipolytica," Biochimica et Biophysica Acta, 1771:228-237 [2007].
Aloulou, A., et al., "Yarrowia lipolytica Lipase 2 Is Stable and Highly Active in Test Meals and Increases Fat Absorption in an Animal Model of Pancreatic Exocrine Insufficiency," Gastroenterology, 149:1910-1919 [2015].
Altschul, S., et al., "Basic local alignment search tool," J. Mol. Biol., 215: 403-410 [1990].
Altschul, S.F., et al., "Gapped BLAST and PSI-BLAST: a new generation of protein database search programs," Nucleic Acids Res., 25(17):3389-3402 [1997].
Beaucage, S.L., et al., "Deoxynucleoside phosphoamidites—A new class of key intermediates for deoxypolynucleotide synthesis," Tetrahedron Letters, 22(20):1859-62 [1981].
Black, M.E., et al., "Creation of drug-specific herpes simplex virus type 1 thymidine kinase mutants for gene therapy," Proc Natl Acad Sci USA, 93:3525-3529 [1996].
Borowitz, D., et al., "International phase III trial of liprotamase efficacy and safety in pancreatic-insufficient cystic fibrosis patients," J. Cystic Fibrosis, 10:443-452 [2011].
Botstein, D., et al., "Strategies and applications of in vitro mutagenesis," Science, 229(4719):1193-1201 [1985].
Brock, A., et al., "Novel ciliate lipases for enzyme replacement during exocrine pancreatic insufficiency," European Journal of Gastroenterology & Hepatology, 28:1305-1312 [2016].
Caldwell, R.C., et al., "Mutagenic PCR," PCR Methods Appl., 3:S136-S140 [1994].
Capolino, P., et al., "In Vitro Gastrointestinal Lipolysis: Replacement of Human Digestive Lipases by a Combination of Rabbit Gastric and Porcine Pancreatic Extracts," Food Dig., 2:43-51 [2011].
Carter, P., "Site-directed mutagenesis," Biochem. J., 237:1-7 [1986].
Christians, F.C., et al., "Directed evolution of thymidine kinase for AZT phosphorylation using DNA family shuffling," Nat. Biotechnol., 17:259-264 [1999].
Crameri, A., et al., "DNA shuffling of a family of genes from diverse species accelerates directed evolution", Nature, 391:288-291 [1998].
Crameri, A., et al., "Improved green fluorescent protein by molecular evolution using DNA shuffling," Nat. Biotechnol., 14(3):315-319 [1996].
Crameri, A., et al., "Molecular evolution of an arsenate detoxification pathway by DNA shuffling," Nat. Biotechnol., 15(5):436-438 [1997].
Dale, S.J., et al., "Oligonucleotide-directed random mutagenesis using the phosphorothioate method," Methods Mol. Biol., 57:369-74 [1996].
De La Iglesia-Garcia, D., et al., "Efficacy of pancreatic enzyme replacement therapy in chronic pancreatitis: systematic review and meta-analysis," Gut, 66:1474-1486 [2017].
Fieker, A., et al., "Enzyme replacement therapy for pancreaticinsufficiency: present and future," Clinical and Experimental Gastroenterology, 4:55-73 [2011].
Gregory, P.C., et al., "The Pancreatic Duct Ligated (Mini)pig as a Model for Pancreatic Exocrine Insufficiency in Man," Pancreas, 45:1213-1226 [2016].
Guo, Z., et al., "3'-End-Forming Signals of Yeast mRNA," Mol. Cell. Biol., 15(11):5983-5990 [1995].
Henikoff, S., et al., "Amino acid substitution matrices from protein blocks," Proc. Natl. Acad. Sci., 89:10915-10919 [1992].
Ikeda, K., et al., "Phenylalanine ammonia-lyase modified with polyethylene glycol: Potential therapeutic agent for phenylketonuria," Amino Acids, 29:283-287 [2005].
Kramer, B., et al., "Different base/base mismatches are corrected with different efficiencies by the methyl-directed DNA mismatch-repair system of E. coli," Cell, 38(3):879-887, [1984].

Ling, M., et al., "Approaches to DNA Mutagenesis:An Overview," Anal. Biochem., 254:157-78 [1997].
Matthes, H.W.D., et al., "Simultaneous rapid chemical synthesis of over one hundred oligonucleotides on a microscale," EMBO J., 3(4):801-05 [1984].
Minshull, J., et al., "Protein evolution by molecular breeding," Curr. Op. Chem. Biol., 3(3):284-290 [1999].
Needleman, S., et al., "A general method applicable to the search for similarities in the amino acid sequence of two proteins," J. Mol. Biol. 48:443-453 [1970].
Pearson, W.R., "Improved tools for biological sequence comparison," Proc. Nat'l. Acad. Sci. USA, 85:2444-2448 [1988].
Pierzynowska, K., et al., "Pancreatic-like enzymes of microbial origin restore growth and normalize lipid absorption in a pig model with exocrine pancreatic insufficiency," Arch. Med. Sci., 14(2):407-414 [2018].
Raimondo, M., et al., "Lipolytic Activity of Bacterial Lipase Survives Better Than That of Porcine Lipase in Human Gastric and Duodenal Content," Gastroenterology, 107:231-235 [1994].
Romanos, M.A., et al., "Foreign gene expression in yeast: a review," Yeast 8:423-488 [1992].
Smith, M., "In vitro mutagenesis," Ann. Rev. Genet., 19:423-462 [1985].
Smith, T., et al., "Comparison of Biosequences," Adv. Appl. Math, 2:482-489 [1981].
Stemmer, W., "DNA Shuffling by Random Fragmentation and Reassembly: In vitro Recombination for Molecular Evolution," Proc. Natl. Acad. Sci. USA, 91:10747-10751 [1994].
Stemmer, W.P.C., "Rapid evolution of a protein in vitro by DNA shuffling", Nature, 370:389-391 [1994].
Struyvenberg, M.R., et al., "Practical guide to exocrine pancreaticinsufficiency—Breaking the myths," BMC Medicine, 15(29):1-8 [2017].
Suzuki, A., et al., "Bacterial Lipase and High-Fat Diets in Canine Exocrine Pancreatic Insufficiency: A New Therapy of Steatorrhea?" Gastroenterology, 112:2048-2055 [1997].
Suzuki, A., et al., "Effect of Bacterial or Porcine Lipase With Low- or High-Fat Diets on Nutrient Absorption in Pancreatic-Insufficient Dogs," Gastroenterology, 116:431-437 [1999].
Szwiec, K., et al., "Novel potential of pancreatic-like enzymes of microbial origin in exocrine pancreatic insufficiency—study on a pig model," Journal of Pre-Clinical and Clinical Research, 9(1):5-10 [2015].
Trang, T., et al., "Pancreatic enzyme replacement therapy for pancreatic exocrine insufficiency in the 21st century," World J. Gastroenterol., 20(33):11467-11485 [2014].
Turki, S., et al., "A highly stable Yarrowia lipolytica lipase formulation for the treatment of pancreatic exocrine insufficiency," Biotechnol. Appl. Biochem., 57:139-149 [2010].
Van De Kamer, J.H., "Total Fatty Acids in Stool", in Seligson (ed), Standard Methods of Clinical Chemistry, [1958], vol. 2, Academic Press, New York, NY, pp. 34-39.
Watson, M., et al., "Total nitrogen", in Peters et al. (eds.), Recommended Methods of Manure Analysis, [2003], Univ. of Wisconsin Cooperative Extension Publishing, Publication No. A3769. Madison, WI, pp. 18-24.
Wells, J.A., et al., "Cassette mutagenesis: an efficient method for generation of multiple mutations at defined sites," Gene, 34:315-323 [1985].
Zhang, J-H., et al., "Directed evolution of a fucosidase from a galactosidase by DNA shuffling and screening," Proc. Nat. Acad. Sci., U.S.A., 94:4504-4509 [1997].
Zhao, H., et al., "Molecular evolution by staggered extension process (StEP) in vitro recombination," Nat. Biotechnol., 16:258-261 [1998].
UniProtKB Accession No. A0A090IW71 dated Nov. 26, 2014.
GenBank Accession No. AWI13148.1, lipase [Caldibacillus thermoamylovorans].
GenBank Accession No. BAU78316.2, lipase [Caldibacillus thermoamylovorans].
NCBI Reference Sequence: WP_176458951.1, lipase [Caldibacillus hisashii].
NCBI Reference Sequence: WP_216406652.1, lipase [Caldibacillus hisashii].

(56) References Cited

OTHER PUBLICATIONS

PCT International Search Report for PCT/US20/48404, dated Mar. 1, 2022.

PCT International Preliminary Report on Patentability for PCT/US20/48404, dated Feb. 2, 2021.

NCBI Reference Sequence: WP_041845597.1, Lipase [Caldibacillus Thermoamylovorans], Feb. 6, 2015, 1 Page.

Office Action Received for Application No. CN202080076739.4, mailed on Jan. 18, 2024, 6 Pages of Official Copy.

Tarantul, "Explanatory Biotechnological Dictionary", 2009, p. 472.

Yampolsky et al., "The Exchangeability of Amino Acids in Proteins", Genetics, vol. 170, Issue No. 4, 2005, pp. 1459-1472.

Whisstock et al., "Prediction of Protein Function from Protein Sequence and Structure", Quarterly Reviews of Biophysics, vol. 36, Issue No. 3, 2003, pp. 307-340.

Broun et al. "Catalytic Plasticity of Fatty Acid Modification Enzymes Underlying Chemical Diversity of Plant Lipids", Science, vol. 282, Nov. 13, 1998, pp. 1315-1317.

Seffernick et al., "Melamine Deaminase and Atrazine Chlorohydrolase: 98 Percent Identical but Functionally Different", Journal Of Bacteriology, vol. 183, Issue No. 8, 2001, pp. 2405-2410.

Witkowski et al., "Conversion of a β-Ketoacyl Synthase to a Malonyl Decarboxylase by Replacement of the Active-Site Cysteine with Glutamine", Biochemistry, vol. 38, 1999, p. 11643-11650.

"Lipase [Caldibacillus Thermoamylovorans]", GenBank: BAH70300.1, Retrieved at <https://www.ncbi.nlm.nih.gov/protein/BAH70300.1?report=genbank&log$=prottop&blast_rank=5&RID=W1B38KDY013>, Jun. 4, 2009, 1 Page.

"Bacillus Thermoamylovorans Gene for Lipase, Complete CDS, Strain: BHK 52", GenBank: AB381879.1, Retrieved at <https://www.ncbi.nlm.nih.gov/nuccore/AB381879.1/>, Jun. 4, 2009, 1 Page.

Thumarat, "Identification, Gene Cloning and Characterization of an Extremely Thermoactive and Thermotolerant Lipase from Bacillus Thermoamylovorans BHK52", 2008, 128 Pages.

Trang et al.,."Pancreatic Enzyme Replacement Therapy for Pancreatic Exocrine Insufficiency in the 21st Century", World Journal of Gastroenterol, vol. 20, Issue No. 33, Sep. 7, 2014, p. 11467-11485.

Office Action Received for Application No. RU2022108059 mailed on Feb. 6, 2024, 13 Pages of Official Copy.

\* cited by examiner

ENGINEERED LIPASE VARIANTS

The present application claims priority to U.S. Prov. Appln. Ser. No. 62/894,019, filed Aug. 30, 2019, which is hereby incorporated by reference in its entirety for all purposes.

FIELD OF THE INVENTION

The present invention provides engineered lipase polypeptides and compositions thereof. The engineered lipase polypeptides have been optimized to provide improved thermostability, protease stability, and stability under a range of pH conditions, including acidic (pH<7) conditions. The invention also relates to the use of the compositions comprising the engineered lipase polypeptides for therapeutic and/or nutritional purposes. The present invention also provides polynucleotides encoding the engineered lipase polypeptides, as well as methods for making the engineered polynucleotides and lipase polypeptides.

REFERENCE TO SEQUENCE LISTING, TABLE OR COMPUTER PROGRAM

The official copy of the Sequence Listing is submitted concurrently with the specification as an ASCII formatted text file via EFS-Web, with a file name of "CX7-187US2_ST25.txt", a creation date of Aug. 27, 2020, and a size of 4.30 megabytes. The Sequence Listing filed via EFS-Web is part of the specification and is incorporated in its entirety by reference herein.

BACKGROUND OF THE INVENTION

Pancreatic enzyme replacement therapy (PERT) finds use in the treatment of pancreatic enzyme insufficiency (PEI). Various disorders, including pancreatitis, cystic fibrosis, celiac disease, inflammatory bowel disease, and pancreatic cancer can lead to PEI, as a consequence of decreased secretion of pancreatic enzymes into the duodenum. This results in poor digestion of food, inadequate absorption of fat, proteins, carbohydrates, and vitamins by the intestines, which can lead to malnutrition. Although orally administered PERT treatments are currently available, the condition may not be alleviated in some people, due to insufficient activity of the PERT in the gastrointestinal tract and/or insufficient patient compliance with the therapy due to the significant pill burden associated with current treatment protocols. In some cases, the coefficient of fat absorption (CFA) and/or coefficient of nitrogen absorption (CNA) is inferior to that of healthy patients, resulting in weight loss and other health concerns. Thus, a need remains in the art for improved PERT treatments.

SUMMARY OF THE INVENTION

The present invention provides engineered lipase polypeptides and compositions thereof. The engineered lipase polypeptides have been optimized to provide improved thermostability, protease stability, and stability under a range of pH conditions, including acidic (pH<7) conditions. The invention also relates to the use of the compositions comprising the engineered lipase polypeptides for therapeutic and/or nutritional purposes. The present invention also provides polynucleotides encoding the engineered lipase polypeptides, as well as methods for making the engineered polynucleotides and lipase polypeptides.

The present invention provide recombinant lipases and/or biologically active recombinant lipase fragments comprising amino acid sequences comprising at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 2. In some embodiments, the recombinant lipase and/or biologically active recombinant lipase fragment comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 94, 350, 442, 540, 646, 758, and/or 868. In some additional embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant lipase comprises at least one substitution or substitution set at one or more positions selected from 2, 3, 4, 22, 27/46/97/136/149/385, 27/46/385, 27/70/136/231/385, 27/136/323/385, 27/149, 27/149/385, 27/385, 34, 38, 41, 44, 46/70, 46/149/183/231/385, 48, 70, 73, 73/305, 82, 82/94/101/194/199, 82/94/199, 83, 85, 87, 89, 92, 94, 96, 97/149/385, 135, 136/385, 140, 141, 142, 144, 146, 149, 149/231/385, 151, 174, 175, 178, 181, 183/385, 189, 194, 194/199, 195, 195/231/385, 199, 199/213, 210, 212, 213, 213/330, 216, 218, 219, 226, 231/385, 238, 247, 250, 270, 274, 281, 292, 296, 300, 308, 330, 338, 379, and 385, wherein the amino acid positions of the polypeptide sequence are numbered with reference to SEQ ID NO: 2. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant lipase comprises at least one substitution or substitution set selected from 2H, 2M, 2T, 3A, 3G, 3R, 3S, 4M, 4W, 4Y, 22N, 27V/46T/97A/136V/149E/385P, 27V/46T/385P, 27V/70N/136V/231E/385P, 27V/136V/323I/385P, 27V/149E, 27V/149E/385P, 27V/385P, 34D, 38A, 38H, 38L, 41V, 44E, 46T/70N, 46T/149E/183L/231E/385P, 48V, 70N, 73C/305I, 73I, 73R, 82C, 82E, 82E/94S/101S/194N/199L, 82E/94S/199L, 82F, 82G, 82L, 83G, 83K, 85I, 85W, 87R, 89A, 89T, 89V, 89W, 92A, 94S, 96E, 96N, 96S, 97A/149E/385P, 135G, 135Q, 135S, 135T, 135V, 136V/385P, 140T, 141A, 141F, 141L, 141S, 142A, 142F, 142I, 142L, 144M, 144R, 144W, 146A, 146F, 146S, 146Y, 149E, 149E/231E/385P, 149K, 149R, 151A, 151I, 151L, 174H, 174R, 175G, 175L, 175R, 178R, 178T, 181H, 183L/385P, 189A, 189E, 189W, 194N, 194N/199L, 194T, 195D/231E/385P, 195V, 199L, 199L/213A, 210A, 210V, 212C, 212G, 212R, 212T, 213A/330T, 213H, 216R, 216T, 216W, 218D, 218G, 218I, 218M, 218T, 219C, 219G, 219K, 219R, 226R, 231E/385P, 238S, 247R, 250T, 270V, 274D, 281K, 281R, 292A, 292C, 292L, 292V, 296M, 296R, 300A, 300D, 300T, 308A, 330Y, 338N, 379T, 385A, 385C, 385D, 385P, 385R, and 385T, wherein the amino acid positions of the polypeptide sequence are numbered with reference to SEQ ID NO: 2. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant lipase comprises at least one substitution or substitution set selected from E2H, E2M, E2T, T3A, T3G, T3R, T3S, S4M, S4W, S4Y, G22N, Y27V/R46T/Y97A/Y136V/T149E/F385P, Y27V/R46T/F385P, Y27V/K70N/Y136V/Q231E/F385P, Y27V/Y136V/K323I/

F385P, Y27V/T149E, Y27V/T149E/F385P, Y27V/F385P, K34D, F38A, F38H, F38L, N41V, G44E, R46T/K70N, R46T/T149E/F183L/Q231E/F385P, Y48V, K70N, T73C/ V305I, T73I, T73R, K82C, K82E, K82E/P94S/D101S/ K194N/I199L, K82E/P94S/I199L, K82F, K82G, K82L, E83G, E83K, G85I, G85W, A87R, F89A, F89T, F89V, F89W, T92A, P94S, I96E, I96N, I96S, Y97A/T149E/F385P, Y135G, Y135Q, Y135S, Y135T, Y135V, Y136V/F385P, P140T, E141A, E141F, E141L, E141S, E142A, E142F, E142I, E142L, I144M, I144R, I144W, P146A, P146F, P146S, P146Y, T149E, T149E/Q231E/F385P, T149K, T149R, G151A, G151I, G151L, E174H, E174R, Q175G, Q175L, Q175R, S178R, S178T, K181H, F183L/F385P, S189A, S189E, S189W, K194N, K194N/I199L, K194T, Q195D/Q231E/F385P, Q195V, I199L, I199L/P213A, K210A, K210V, Q212C, Q212G, Q212R, Q212T, P213A/ N330T, P213H, S216R, S216T, S216W, H218D, H218G, H218I, H218M, H218T, A219C, A219G, A219K, A219R, T226R, Q231E/F385P, Y238S, E247R, Q250T, R270V, T274D, G281K, G281R, M292A, M292C, M292L, M292V, S296M, S296R, Q300A, Q300D, Q300T, R308A, N330Y, K338N, N379T, F385A, F385C, F385D, F385P, F385R, and F385T, wherein the amino acid positions of the polypeptide sequence are numbered with reference to SEQ ID NO: 2.

In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 94, or a functional fragment thereof, and wherein the recombinant lipase comprises at least one substitution or substitution set at one or more positions selected from 3/4/96/296/ 300, 3/292/296, 4, 4/11/149/292/296/300, 4/96/149/231/ 296/300, 4/96/149/292/296/300, 4/96/219/296, 4/96/231/ 296/300, 4/96/292/296/300, 4/149/174, 4/174/219/292/296, 4/231/296/300, 27, 27/34/82, 27/73/82/218, 27/89, 27/89/ 178, 27/89/218, 27/218, 34/73/218, 34/82, 34/218, 73/82, 73/82/183, 94/146/175, 96/149/174/292/296, 96/149/231/ 292/296, 96/149/292/296, 96/174/219/231/292/296, 96/231/ 296, 146/175/189/281, 149/174/292/296, 149/174/300, 149/ 219/231/292/296/300, 149/231/292/296, 149/231/292/296/ 300, 149/296, 149/296/300, 174/231, 174/296, 218, 231, 231/292/296, 231/292/296/300, 231/296, 231/300, 292/296, 292/296/300, 296, and 296/300, wherein the amino acid positions of the polypeptide sequence are numbered with reference to SEQ ID NO: 94. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 94, or a functional fragment thereof, and wherein the recombinant lipase comprises at least one substitution or substitution set selected from 3S/4W/96E/ 296R/300D, 3S/292L/296R, 4W, 4W/11A/149E/292L/ 296R/300D, 4W/96E/149E/231E/296R/300D, 4W/96E/ 149E/292L/296R/300D, 4W/96E/219K/296R, 4W/96E/ 231E/296R/300D, 4W/96E/292L/296R/300D, 4W/149E/ 174R, 4W/174H/219K/292L/296R, 4W/231E/296R/300D, 27V, 27V/34D/82E, 27V/73I/82L/218I, 27V/73I/82L/ 218M, 27V/89T, 27V/89T/178P, 27V/89T/218I, 27V/218I, 34D/73I/218I, 34D/82C, 34D/218M, 73I/82C, 73I/82L/ 183L, 94S/146F/175G, 96E/149E/174H/292L/296R, 96E/ 149E/231E/292L/296R, 96E/149E/292L/296R, 96E/174H/ 219K/231E/292L/296R, 96E/231E/296R, 146F/175G/ 189A/281K, 149E/174H/292L/296R, 149E/174H/300D, 149E/219K/231E/292L/296R/300D, 149E/231E/292L/ 296R, 149E/231E/292L/296R/300D, 149E/296R, 149E/ 296R/300D, 174H/296R, 174R/231E, 218I, 231E, 231E/ 292L/296R, 231E/292L/296R/300D, 231E/296R, 231E/ 300D, 292L/296R, 292L/296R/300D, 296R, and 296R/ 300D, wherein the amino acid positions of the polypeptide sequence are numbered with reference to SEQ ID NO: 94.

In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 94, or a functional fragment thereof, and wherein the recombinant lipase comprises at least one substitution or substitution set selected from T3S/S4W/I96E/S296R/Q300D, T3S/M292L/S296R, S4W, S4W/V11A/T149E/M292L/ S296R/Q300D, S4W/I96E/T149E/Q231E/S296R/Q300D, S4W/I96E/T149E/M292L/S296R/Q300D, S4W/I96E/ A219K/S296R, S4W/I96E/Q231E/S296R/Q300D, S4W/ I96E/M292L/S296R/Q300D, S4W/T149E/E174R, S4W/ E174H/A219K/M292L/S296R, S4W/Q231E/S296R/ Q300D, Y27V, Y27V/K34D/K82E, Y27V/T73I/K82L/ H218I, Y27V/T73I/K82L/H218M, Y27V/F89T, Y27V/ F89T/S178P, Y27V/F89T/H218I, Y27V/H218I, K34D/ T73I/H218I, K34D/K82C, K34D/H218M, T73I/K82C, T73I/K82L/F183L, P94S/P146F/Q175G, I96E/T149E/ E174H/M292L/S296R, I96E/T149E/Q231E/M292L/ S296R, I96E/T149E/M292L/S296R, I96E/E174H/A219K/ Q231E/M292L/S296R, I96E/Q231E/S296R, P146F/ Q175G/S189A/G281K, T149E/E174H/M292L/S296R, T149E/E174H/Q300D, T149E/A219K/Q231E/M292L/ S296R/Q300D, T149E/Q231E/M292L/S296R, T149E/ Q231E/M292L/S296R/Q300D, T149E/S296R, T149E/ S296R/Q300D, E174H/S296R, E174R/Q231E, H218I, Q231E, Q231E/M292L/S296R, Q231E/M292L/S296R/ Q300D, Q231E/S296R, Q231E/Q300D, M292L/S296R, M292L/S296R/Q300D, S296R, and S296R/Q300D, wherein the amino acid positions of the polypeptide sequence are numbered with reference to SEQ ID NO: 94.

In some additional embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 350, or a functional fragment thereof, and wherein the recombinant lipase comprises at least one substitution or substitution set at one or more positions selected from 4, 4/27/189/300, 4/70, 4/102, 4/137, 4/175/189/218, 4/175/ 189/300, 4/175/218/224, 4/175/218/373, 4/185, 4/189/218/ 373, 4/193, 4/218/300/369/373, 4/228, 4/233, 4/243, 4/271, 4/303, 4/334, 4/336, 4/375, 25, 27/82/174/175/189/218/300/ 369/373, 27/82/174/175/218/300/369, 27/82/174/175/218/ 300/373/382, 27/82/174/218/300/373, 27/189/218/373, 28, 33, 99, 102, 104, 134, 153, 174/175/189, 174/373, 175/189/ 218/300/373, 175/189/373, 175/218, 175/218/382, 189/218/ 300/373, 191, 193, 231, 233, 243, 293, 303, 331, 336, 339, 368, and 373, wherein the amino acid positions of the polypeptide sequence are numbered with reference to SEQ ID NO: 350. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 350, or a functional fragment thereof, and wherein the recombinant lipase comprises at least one substitution or substitution set selected from 4W, 4W/27V/ 189A/300D, 4W/70H, 4W/102T, 4W/137R, 4W/175G/ 189A/218M, 4W/175G/189A/300D, 4W/175G/218M/ 224A, 4W/175G/218M/373F, 4W/185L, 4W/189A/218M/ 373F, 4W/193T, 4W/218M/300D/369N/373F, 4W/228E, 4W/233R, 4W/243R, 4W/271D, 4W/303P, 4W/334T, 4W/336S, 4W/336T, 4W/375A, 25V, 27V/82C/174H/175G/ 189A/218M/300D/369N/373F, 27V/82C/174H/175G/ 218M/300D/369N, 27V/82C/174H/175G/218M/300D/

373F/382M, 27V/82C/174H/218M/300D/373F, 27V/189A/ 218M/373F, 28N, 33Y, 99D, 102L, 104H, 134R, 153G, 174H/175L/189A, 174H/373F, 175G/189A/218M/300D/ 373F, 175G/218M, 175G/218M/382M, 175L/189A/373F, 189A/218M/300D/373F, 191L, 193L, 231Q, 233G, 233S, 233W, 243R, 293R, 303P, 331R, 336R, 339K, 368A, 368T, and 373F, wherein the amino acid positions of the polypeptide sequence are numbered with reference to SEQ ID NO: 350. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 350, or a functional fragment thereof, and wherein the recombinant lipase comprises at least one substitution or substitution set selected from S4W, S4W/Y27V/S189A/ Q300D, S4W/K70H, S4W/E102T, S4W/S137R, S4W/ Q175G/S189A/H218M, S4W/Q175G/S189A/Q300D, S4W/Q175G/H218M/V224A, S4W/Q175G/H218M/ Y373F, S4W/I185L, S4W/S189A/H218M/Y373F, S4W/ Q193T, S4W/H218M/Q300D/S369N/Y373F, S4W/P228E, S4W/N233R, S4W/L243R, S4W/G271D, S4W/A303P, S4W/D334T, S4W/A336S, S4W/A336T, S4W/N375A, L25V, Y27V/K82C/E174H/Q175G/H218M/ Q300D/S369N/Y373F, Y27V/K82C/E174H/Q175G/ H218M/Q300D/S369N, Y27V/K82C/E174H/Q175G/ H218M/Q300D/Y373F/H382M, Y27V/K82C/E174H/ H218M/Q300D/Y373F, Y27V/S189A/H218M/Y373F, R28N, L33Y, Q99D, E102L, N104H, E134R, N153G, E174H/Q175L/S189A, E174H/Y373F, Q175G/S189A/ H218M/Q300D/Y373F, Q175G/H218M, Q175G/H218M/ H382M, Q175L/S189A/Y373F, S189A/H218M/Q300D/ Y373F, A191L, Q193L, E231Q, N233G, N233S, N233W, L243R, Q293R, A303P, S331R, A336R, Q339K, F368A, F368T, and Y373F, wherein the amino acid positions of the polypeptide sequence are numbered with reference to SEQ ID NO: 350.

In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO:442, or a functional fragment thereof, and wherein the recombinant lipase comprises at least one substitution or substitution set at one or more positions selected from 26, 33, 33/174/193/243, 33/174/334, 33/175/218/303, 33/175/ 218/334/339, 33/193, 34, 38, 46, 48, 70/271/293/334, 144, 174, 174/175/193, 174/175/218/339, 174/193/303/375, 174/ 193/375, 174/218/233/271/293/303, 174/218/271/303, 175/ 193/218/233/243/375, 175/193/218/243, 175/218/375, 181, 189, 193, 193/218/243, 193/271/303/334, 193/293/303, 194, 195, 199, 210, 218, 218/243, 218/243/303/334, 218/303, 225, 238, 274, 281, and 330, wherein the amino acid positions of the polypeptide sequence are numbered with reference to SEQ ID NO: 442. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 442, or a functional fragment thereof, and wherein the recombinant lipase comprises at least one substitution or substitution set selected from 26A, 26R, 26S, 33Y, 33Y/174H/193L/243R, 33Y/ 174H/334T, 33Y/175G/218M/303P, 33Y/175G/218M/ 334T/339K, 33Y/193L, 34L, 38A, 38G, 46P, 48L, 70H/ 271D/293R/334T, 144L, 174H, 174H/175G/193L, 174H/ 175G/218M/339K, 174H/193L/303P/375A, 174H/193L/ 375A, 174H/218M/233R/271D/293R/303P, 174H/218M/ 271D/303P, 174R, 175G/193L/218M/233R/243R/375A, 175G/193L/218M/243R, 175G/218M/375A, 181Q, 189H, 193L, 193L/218M/243R, 193L/271D/303P/334T, 193L/ 293R/303P, 194T, 195I, 195L, 195Y, 199H, 210V, 218C, 218D, 218M, 218M/243R, 218M/243R/303P/334T, 218M/ 303P, 218P, 225L, 238W, 274D, 281K, 281P, 330F, and 330H, wherein the amino acid positions of the polypeptide sequence are numbered with reference to SEQ ID NO: 442.

In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 442, or a functional fragment thereof, and wherein the recombinant lipase comprises at least one substitution or substitution set selected from G26A, G26R, G26S, L33Y, L33Y/E174H/Q193L/L243R, L33Y/E174H/D334T, L33Y/ L175G/H218M/A303P, L33Y/L175G/H218M/D334T/ Q339K, L33Y/Q193L, K34L, F38A, F38G, R46P, Y48L, K70H/G271D/Q293R/D334T, I144L, E174H, E174H/ L175G/Q193L, E174H/L175G/H218M/Q339K, E174H/ Q193L/A303P/N375A, E174H/Q193L/N375A, E174H/ H218M/N233R/G271D/Q293R/A303P, E174H/H218M/ G271D/A303P, E174R, L175G/Q193L/H218M/N233R/ L243R/N375A, L175G/Q193L/H218M/L243R, L175G/ H218M/N375A, K181Q, A189H, Q193L, Q193L/H218M/ L243R, Q193L/G271D/A303P/D334T, Q193L/Q293R/ A303P, K194T, Q195I, Q195L, Q195Y, I199H, K210V, H218C, H218D, H218M, H218M/L243R, H218M/L243R/ A303P/D334T, H218M/A303P, H218P, M225L, Y238W, T274D, G281K, G281P, N330F, and N330H, wherein the amino acid positions of the polypeptide sequence are numbered with reference to SEQ ID NO: 442.

In some additional embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 540, or a functional fragment thereof, and wherein the recombinant lipase comprises at least one substitution or substitution set at one or more positions selected from 34/38/174/193/195/243/281/303/330, 34/38/174/225/303, 34/38/174/303/345, 34/174, 34/174/193/195/243/281, 34/174/193/195/303/330, 34/193/195/225/243, 34/193/243/ 303/330, 34/281/330, 38, 38/174/193/195/243/330, 38/174/ 193/225/274/283/303/330, 38/174/193/303, 38/174/195/ 281/330, 38/174/225/243/281/330, 38/174/281, 38/174/281/ 303, 38/174/281/303/345, 38/193/195/225/303/345, 38/195/ 243/303, 38/195/281/303/330, 38/195/281/330, 38/195/303, 49, 49/51/98/252/311, 49/51/123/252/344, 49/98/120/252/ 344, 49/120/252/344, 49/123/252/344, 49/123/264/344, 49/123/311, 49/252/344, 49/311/344, 49/344, 51, 51/252/ 344, 51/344, 98, 98/344, 123/252/344, 129, 160, 161, 174/ 193/195/225, 174/193/303/330, 174/195/225/281/303/330/ 345, 174/195/243/281/345, 174/195/281/303, 174/225/243/ 281/303/345, 174/281/330, 174/303, 195/225/303/330, 252, 268, and 344, wherein the amino acid positions of the polypeptide sequence are numbered with reference to SEQ ID NO: 540. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 540, or a functional fragment thereof, and wherein the recombinant lipase comprises at least one substitution or substitution set selected from 34L/38A/ 174G/193L/195L/243R/281P/303P/330F, 34L/38A/174R/ 303P/345I, 34L/38G/174R/225L/303P, 34L/174G, 34L/ 174G/193L/195L/243R/281P, 34L/174H/193L/195I/303P/ 330F, 34L/193L/195I/225L/243R, 34L/193L/243R/303P/ 330F, 34L/281P/330H, 38A/174H/193L/225L/274D/283I/ 303P/330F, 38A/174R/281K/303P/345I, 38A/193L/195L/

225L/303P/345I, 38A/195I/303P, 38A/195Y/281K/303P/ 330F, 38G, 38G/174G/193L/303P, 38G/174G/281K/303P, 38G/174H/195L/281P/330F, 38G/174H/225L/243R/281K/ 330H, 38G/174H/281K, 38G/174R/193L/195L/243R/330H, 38G/195I/281P/330F, 38G/195Y/243R/303P, 49S, 49T, 49T/51A/98P/252V/311W, 49T/51A/123Q/252V/344H, 49T/98P/120T/252V/344H, 49T/120T/252V/344H, 49T/ 123Q/252V/344H, 49T/123Q/264S/344H, 49T/123Q/ 311W, 49T/252V/344H, 49T/311W/344H, 49T/344H, 51A/ 252V/344H, 51A/344H, 51V, 98P/344H, 98R, 123Q/252V/ 344H, 129F, 160T, 161I, 174G/195I/225L/281K/303P/ 330F/345I, 174G/225L/243R/281P/303P/345I, 174H/195I/ 243R/281K/345I, 174H/281P/330H, 174R/193L/195I/ 225L, 174R/193L/303P/330H, 174R/195I/281K/303P, 174R/303P, 195Y/225L/303P/330H, 252V, 268T, 344I, 344V, and 344W, wherein the amino acid positions of the polypeptide sequence are numbered with reference to SEQ ID NO: 540. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 540, or a functional fragment thereof, and wherein the recombinant lipase comprises at least one substitution or substitution set selected from K34L/F38A/ E174G/Q193L/Q195L/L243R/G281P/A303P/N330F, K34L/F38A/E174R/A303P/F345I, K34L/F38G/E174R/ M225L/A303P, K34L/E174G, K34L/E174G/Q193L/ Q195L/L243R/G281P, K34L/E174H/Q193L/Q195I/ A303P/N330F, K34L/Q193L/Q195I/M225L/L243R, K34L/ Q193L/L243R/A303P/N330F, K34L/G281P/N330H, F38A/ E174H/Q193L/M225L/T274D/M283I/A303P/N330F, F38A/E174R/G281K/A303P/F345I, F38A/Q193L/Q195L/ M225L/A303P/F345I, F38A/Q195I/A303P, F38A/Q195Y/ G281K/A303P/N330F, F38G, F38G/E174G/Q193L/A303P, F38G/E174G/G281K/A303P, F38G/E174H/Q195L/G281P/ N330F, F38G/E174H/M225L/L243R/G281K/N330H, F38G/E174H/G281K, F38G/E174R/Q193L/Q195L/L243R/ N330H, F38G/Q195I/G281P/N330F, F38G/Q195Y/L243R/ A303P, V49S, V49T, V49T/T51A/G98P/M252V/L311W, V49T/T51A/E123Q/M252V/S344H, V49T/G98P/M120T/ M252V/S344H, V49T/M120T/M252V/S344H, V49T/ E123Q/M252V/S344H, V49T/E123Q/T264S/S344H, V49T/E123Q/L311W, V49T/M252V/S344H, V49T/ L311W/S344H, V49T/S344H, T51A/M252V/S344H, T51A/S344H, T51V, G98P/S344H, G98R, E123Q/M252V/ S344H, S129F, S160T, L161I, E174G/Q195I/M225L/ G281K/A303P/N330F/F345I, E174G/M225L/L243R/ G281P/A303P/F345I, E174H/Q195I/L243R/G281K/F345I, E174H/G281P/N330H, E174R/Q193L/Q195I/M225L, E174R/Q193L/A303P/N330H, E174R/Q195I/G281K/ A303P, E174R/A303P, Q195Y/M225L/A303P/N330H, M252V, S268T, S344I, S344V, and S344W, wherein the amino acid positions of the polypeptide sequence are numbered with reference to SEQ ID NO: 540.

In some additional embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 646, or a functional fragment thereof, and wherein the recombinant lipase comprises at least one substitution or substitution set at one or more positions selected from 11/16/67/168/180/287, 11/16/237/241/287, 11/67/168/287, 16/67/154/168/237/241/287, 16/67/237/287/291, 16/168/ 177, 24, 24/278, 34/49/161/193/243/344, 34/49/161/193/ 344, 34/49/161/243/344, 34/49/161/252/268/344, 34/49/ 193/243/252/344, 34/49/193/344, 34/49/243/252, 34/49/ 252/268/344, 34/161/193/243/252/268, 34/161/193/243/ 268/344, 34/161/193/243/344, 34/161/193/252/268/344, 34/161/193/252/344, 34/161/193/268/344, 34/161/243/281/ 344, 34/161/344, 34/193/243/252/344, 34/193/252/268/344, 34/193/268/281, 34/252/268/281/344, 34/252/344, 49/161/ 193/243/252/344, 49/161/193/252/281/344, 49/161/243/ 252/344, 49/193/197/243/252/281/344, 49/193/243/252/ 344, 49/193/243/344, 49/243/344, 67/154/237/287, 67/168/ 237, 67/168/237/287, 67/177/237, 154/237/286/287, 154/ 286/287, 161/193/252/344, 161/193/344, 161/344, 168/237, 186/187/278, 193/243/281/344, 193/252/268/344, 193/252/ 281/344, 237, 237/287/291, and 281/344, wherein the amino acid positions of the polypeptide sequence are numbered with reference to SEQ ID NO: 646. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 646, or a functional fragment thereof, and wherein the recombinant lipase comprises at least one substitution or substitution set selected from 11I/16F/67A/168T/180V/287L, 11I/16F/237Q/241S/ 287L, 11I/67A/168T/287L, 16F/67A/154Y/168T/237Q/ 241S/287L, 16F/67A/237Q/287L/291A, 16F/168T/177L, 24M, 24M/278L, 34K/49T/161I/193L/243R/344H, 34K/ 49T/161I/193L/243R/344V, 34K/49T/161I/193L/344W, 34K/49T/161I/243R/344H, 34K/49T/161I/252V/268T/ 344V, 34K/49T/193L/243R/252V/344W, 34K/49T/193L/ 344H, 34K/49T/193L/344W, 34K/49T/243R/252V, 34K/ 49T/252V/268T/344V, 34K/161I/193L/243R/252V/268T, 34K/161I/193L/243R/268T/344V, 34K/161I/193L/243R/ 344W, 34K/161I/193L/252V/268T/344H, 34K/161I/193L/ 252V/268T/344V, 34K/161I/193L/252V/344H, 34K/161I/ 193L/252V/344V, 34K/161I/193L/252V/344W, 34K/161I/ 193L/268T/344H, 34K/161I/243R/281P/344V, 34K/161I/ 344V, 34K/161I/344W, 34K/193L/243R/252V/344W, 34K/ 193L/252V/268T/344H, 34K/193L/268T/281P, 34K/252V/ 268T/281P/344V, 34K/252V/344V, 49T/161I/193L/243R/ 252V/344W, 49T/161I/193L/252V/281P/344H, 49T/161I/ 243R/252V/344V, 49T/193L/197G/243R/252V/281P/ 344H, 49T/193L/243R/252V/344V, 49T/193L/243R/344W, 49T/243R/344V, 67A/154Y/237Q/287L, 67A/168T/237Q, 67A/168T/237Q/287L, 67A/177L/237Q, 154Y/237Q/ 286V/287L, 154Y/286V/287L, 161I/193L/252V/344V, 161I/193L/344W, 161I/344W, 168T/237Q, 186I/187A/ 278L, 193L/243R/281P/344W, 193L/252V/268T/344V, 193L/252V/281P/344H, 237Q, 237Q/287L/291A, and 281P/344W, wherein the amino acid positions of the polypeptide sequence are numbered with reference to SEQ ID NO: 646. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 646, or a functional fragment thereof, and wherein the recombinant lipase comprises at least one substitution or substitution set selected from V11I/L16F/ Y67A/S168T/I180V/F287L, V11I/L16F/A237Q/T241S/ F287L, V11I/Y67A/S168T/F287L, L16F/Y67A/W154Y/ S168T/A237Q/T241S/F287L, L16F/Y67A/A237Q/F287L/ S291A, L16F/S168T/V177L, F24M, F24M/Y278L, L34K/ V49T/L161I/Q193L/L243R/S344H, L34K/V49T/L161I/ Q193L/L243R/S344V, L34K/V49T/L161I/Q193L/S344W, L34K/V49T/L161I/L243R/S344H, L34K/V49T/L161I/ M252V/S268T/S344V, L34K/V49T/Q193L/L243R/ M252V/S344W, L34K/V49T/Q193L/S344H, L34K/V49T/ Q193L/S344W, L34K/V49T/L243R/M252V, L34K/V49T/ M252V/S268T/S344V, L34K/L161I/Q193L/L243R/ M252V/S268T, L34K/L161I/Q193L/L243R/S268T/S344V, L34K/L161I/Q193L/L243R/S344W, L34K/L161I/Q193L/

M252V/S268T/S344H, L34K/L161I/Q193L/M252V/ S268T/S344V, L34K/L161I/Q193L/M252V/S344H, L34K/ L161I/Q193L/M252V/S344V, L34K/L161I/Q193L/ M252V/S344W, L34K/L161I/Q193L/S268T/S344H, L34K/ L161I/L243R/G281P/S344V, L34K/L161I/S344V, L34K/ L161I/S344W, L34K/Q193L/L243R/M252V/S344W, L34K/Q193L/M252V/S268T/S344H, L34K/Q193L/S268T/ G281P, L34K/M252V/S268T/G281P/S344V, L34K/ M252V/S344V, V49T/L161I/Q193L/L243R/M252V/ S344W, V49T/L161I/Q193L/M252V/G281P/S344H, V49T/L161I/L243R/M252V/S344V, V49T/Q193L/S197G/ L243R/M252V/G281P/S344H, V49T/Q193L/L243R/ M252V/S344V, V49T/Q193L/L243R/S344W, V49T/ L243R/S344V, Y67A/W154Y/A237Q/F287L, Y67A/ S168T/A237Q, Y67A/S168T/A237Q/F287L, Y67A/ V177L/A237Q, W154Y/A237Q/L286V/F287L, W154Y/ L286V/F287L, L161I/Q193L/M252V/S344V, L161I/ Q193L/S344W, L161I/S344W, S168T/A237Q, H186T/ L187A/Y278L, Q193L/L243R/G281P/S344W, Q193L/ M252V/S268T/S344V, Q193L/M252V/G281P/S344H, A237Q, A237Q/F287L/S291A, and G281P/S344W, wherein the amino acid positions of the polypeptide sequence are numbered with reference to SEQ ID NO: 646. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 758, or a functional fragment thereof, and wherein the recombinant lipase comprises at least one substitution or substitution set at one or more positions selected from 24/168/252/281, 24/237/287/344, 24/252, 24/252/287, 24/344, 213/252/278/344, 252/278/344, 252/287/344, and 281, wherein the amino acid positions of the polypeptide sequence are numbered with reference to SEQ ID NO: 758. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 758, or a functional fragment thereof, and wherein the recombinant lipase comprises at least one substitution or substitution set selected from 24M/168T/252V/281P, 24M/ 237Q/287L/344S, 24M/252V, 24M/252V/287L, 24M/ 344W, 213S/252V/278L/344S, 252V/278L/344W, 252V/ 287L/344S, and 281P, wherein the amino acid positions of the polypeptide sequence are numbered with reference to SEQ ID NO: 758. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 758, or a functional fragment thereof, and wherein the recombinant lipase comprises at least one substitution or substitution set selected from F24M/S168T/ M252V/G281P, F24M/A237Q/F287L/H344S, F24M/ M252V, F24M/M252V/F287L, F24M/H344W, P213S/ M252V/Y278L/H344S, M252V/Y278L/H344W, M252V/ F287L/H344S, and G281P, wherein the amino acid positions of the polypeptide sequence are numbered with reference to SEQ ID NO: 758.

In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 868, or a functional fragment thereof, and wherein the recombinant lipase comprises at least one substitution or substitution set at one or more positions selected from 24, 24/38/49/70/149/161/174/175/189/193/225/231/243/252/ 271/287/292/293/296/303/334/344/373/385, 38, 49, 70, 149, 161, 174, 175, 189, 193, 225, 231, 243, 252, 271, 287, 292, 293, 296, 303, 334, 344, 373, and 385, wherein the amino acid positions of the polypeptide sequence are numbered with reference to SEQ ID NO: 868. In some embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 868, or a functional fragment thereof, and wherein the recombinant lipase comprises at least one substitution or substitution set selected from 24A, 24C, 24D, 24E, 24F, 24F/38F/49V/70K/149T/ 161L/174E/175Q/189S/193Q/225M/231Q/243L/252M/ 271G/287F/292M/293Q/296S/303A/334D/344S/373Y/ 385F, 24G, 24H, 24I, 24K, 24L, 24N, 24P, 24Q, 24R, 24S, 24T, 24V, 24W, 24Y, 38A, 38C, 38D, 38E, 38F, 38H, 38I, 38K, 38L, 38M, 38N, 38P, 38Q, 38R, 38S, 38T, 38V, 38W, 38Y, 49A, 49C, 49D, 49E, 49F, 49G, 49H, 49I, 49K, 49L, 49M, 49N, 49P, 49Q, 49R, 49S, 49V, 49W, 49Y, 70A, 70C, 70D, 70E, 70F, 70G, 70I, 70K, 70L, 70M, 70N, 70P, 70Q, 70R, 70S, 70T, 70V, 70W, 70Y, 149A, 149C, 149D, 149F, 149G, 149H, 149I, 149K, 149L, 149M, 149N, 149P, 149Q, 149R, 149S, 149T, 149V, 149W, 149Y, 161A, 161C, 161D, 161E, 161F, 161G, 161H, 161K, 161L, 161M, 161N, 161P, 161Q, 161R, 161S, 161T, 161V, 161W, 161Y, 174A, 174C, 174D, 174E, 174F, 174G, 174H, 174I, 174K, 174L, 174M, 174N, 174P, 174Q, 174S, 174T, 174V, 174W, 174Y, 175A, 175C, 175D, 175E, 175F, 175G, 175H, 175I, 175K, 175M, 175N, 175P, 175Q, 175R, 175S, 175T, 175V, 175W, 175Y, 189C, 189D, 189E, 189F, 189G, 189H, 189I, 189K, 189L, 189M, 189N, 189P, 189Q, 189R, 189S, 189T, 189V, 189W, 189Y, 193A, 193C, 193D, 193E, 193F, 193G, 193H, 193I, 193K, 193M, 193N, 193P, 193Q, 193R, 193S, 193T, 193V, 193W, 193Y, 225A, 225C, 225D, 225E, 225F, 225G, 225H, 225I, 225K, 225M, 225N, 225P, 225Q, 225R, 225S, 225T, 225V, 225W, 225Y, 231A, 231C, 231D, 231F, 231G, 231H, 231I, 231K, 231L, 231M, 231N, 231P, 231Q, 231R, 231S, 231T, 231V, 231W, 231Y, 243A, 243C, 243D, 243E, 243F, 243G, 243H, 243I, 243K, 243L, 243M, 243N, 243P, 243Q, 243S, 243T, 243V, 243W, 243Y, 252A, 252C, 252D, 252E, 252F, 252G, 252H, 252I, 252K, 252L, 252M, 252N, 252P, 252Q, 252R, 252S, 252T, 252W, 252Y, 271A, 271C, 271E, 271F, 271G, 271H, 271I, 271K, 271L, 271M, 271N, 271P, 271Q, 271R, 271S, 271T, 271V, 271W, 271Y, 287A, 287C, 287D, 287E, 287F, 287G, 287H, 287I, 287K, 287M, 287N, 287P, 287Q, 287R, 287S, 287T, 287V, 287W, 287Y, 292A, 292C, 292D, 292E, 292F, 292G, 292H, 292I, 292K, 292M, 292N, 292P, 292Q, 292R, 292S, 292T, 292V, 292W, 292Y, 293A, 293C, 293D, 293E, 293F, 293G, 293H, 293I, 293K, 293L, 293M, 293N, 293P, 293Q, 293S, 293T, 293V, 293W, 293Y, 296A, 296C, 296D, 296E, 296F, 296G, 296H, 296I, 296K, 296L, 296M, 296N, 296P, 296Q, 296S, 296T, 296V, 296W, 296Y, 303A, 303C, 303D, 303E, 303F, 303G, 303H, 303I, 303K, 303L, 303M, 303N, 303Q, 303R, 303S, 303T, 303V, 303W, 303Y, 334A, 334C, 334D, 334E, 334F, 334G, 334H, 334I, 334K, 334L, 334M, 334N, 334P, 334Q, 334R, 334S, 334V, 334W, 334Y, 344A, 344C, 344D, 344E, 344F, 344G, 344I, 344K, 344L, 344M, 344N, 344P, 344Q, 344R, 344S, 344T, 344V, 344W, 344Y, 373A, 373C, 373D, 373E, 373G, 373H, 373I, 373K, 373L, 373M, 373N, 373P, 373Q, 373R, 373S, 373T, 373V, 373W, 373Y, 385A, 385C, 385D, 385E, 385F, 385G, 385H, 385I, 385K, 385L, 385M, 385N, 385Q, 385R, 385S, 385T, 385V, 385W, and 385Y, wherein the amino acid positions of the polypeptide sequence are numbered with reference to SEQ ID NO: 868. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 868, or a functional fragment thereof, and wherein the recombinant lipase comprises at least one substitution or substitution set selected from M24A, M24C, M24D, M24E, M24F, M24F/G38F/T49V/H70K/E149T/I161L/R174E/L175Q/A189S/L193Q/L225M/E231Q/R243L/V252M/D271G/L287F/L292M/R293Q/R296S/P303A/T334D/H344S/F373Y/P385F, M24G, M24H, M24I, M24K, M24L, M24N, M24P, M24Q, M24R, M24S, M24T, M24V, M24W, M24Y, G38A, G38C, G38D, G38E, G38F, G38H, G38I, G38K, G38L, G38M, G38N, G38P, G38Q, G38R, G38S, G38T, G38V, G38W, G38Y, T49A, T49C, T49D, T49E, T49F, T49G, T49H, T49I, T49K, T49L, T49M, T49N, T49P, T49Q, T49R, T49S, T49V, T49W, T49Y, H70A, H70C, H70D, H70E, H70F, H70G, H70I, H70K, H70L, H70M, H70N, H70P, H70Q, H70R, H70S, H70T, H70V, H70W, H70Y, E149A, E149C, E149D, E149F, E149G, E149H, E149I, E149K, E149L, E149M, E149N, E149P, E149Q, E149R, E149S, E149T, E149V, E149W, E149Y, I161A, I161C, I161D, I161E, I161F, I161G, I161H, I161K, I161L, I161M, I161N, I161P, I161Q, I161R, I161S, I161T, I161V, I161W, I161Y, R174A, R174C, R174D, R174E, R174F, R174G, R174H, R174I, R174K, R174L, R174M, R174N, R174P, R174Q, R174S, R174T, R174V, R174W, R174Y, L175A, L175C, L175D, L175E, L175F, L175G, L175H, L175I, L175K, L175M, L175N, L175P, L175Q, L175R, L175S, L175T, L175V, L175W, L175Y, A189C, A189D, A189E, A189F, A189G, A189H, A189I, A189K, A189L, A189M, A189N, A189P, A189Q, A189R, A189S, A189T, A189V, A189W, A189Y, L193A, L193C, L193D, L193E, L193F, L193G, L193H, L193I, L193K, L193M, L193N, L193P, L193Q, L193R, L193S, L193T, L193V, L193W, L193Y, L225A, L225C, L225D, L225E, L225F, L225G, L225H, L225I, L225K, L225M, L225N, L225P, L225Q, L225R, L225S, L225T, L225V, L225W, L225Y, E231A, E231C, E231D, E231F, E231G, E231H, E231I, E231K, E231L, E231M, E231N, E231P, E231Q, E231R, E231S, E231T, E231V, E231W, E231Y, R243A, R243C, R243D, R243E, R243F, R243G, R243H, R243I, R243K, R243L, R243M, R243N, R243P, R243Q, R243S, R243T, R243V, R243W, R243Y, V252A, V252C, V252D, V252E, V252F, V252G, V252H, V252I, V252K, V252L, V252M, V252N, V252P, V252Q, V252R, V252S, V252T, V252W, V252Y, D271A, D271C, D271E, D271F, D271G, D271H, D271I, D271K, D271L, D271M, D271N, D271P, D271Q, D271R, D271S, D271T, D271V, D271W, D271Y, L287A, L287C, L287D, L287E, L287F, L287G, L287H, L287I, L287K, L287M, L287N, L287P, L287Q, L287R, L287S, L287T, L287V, L287W, L287Y, L292A, L292C, L292D, L292E, L292F, L292G, L292H, L292I, L292K, L292M, L292N, L292P, L292Q, L292R, L292S, L292T, L292V, L292W, L292Y, R293A, R293C, R293D, R293E, R293F, R293G, R293H, R293I, R293K, R293L, R293M, R293N, R293P, R293Q, R293S, R293T, R293V, R293W, R293Y, R296A, R296C, R296D, R296E, R296F, R296G, R296H, R296I, R296K, R296L, R296M, R296N, R296P, R296Q, R296S, R296T, R296V, R296W, R296Y, P303A, P303C, P303D, P303E, P303F, P303G, P303H, P303I, P303K, P303L, P303M, P303N, P303Q, P303R, P303S, P303T, P303V, P303W, P303Y, T334A, T334C, T334D, T334E, T334F, T334G, T334H, T334I, T334K, T334L, T334M, T334N, T334P, T334Q, T334R, T334S, T334V, T334W, T334Y, H344A, H344C, H344D, H344E, H344F, H344G, H344I, H344K, H344L, H344M, H344N, H344P, H344Q, H344R, H344S, H344T, H344V, H344W, H344Y, F373A, F373C, F373D, F373E, F373G, F373H, F373I, F373K, F373L, F373M, F373N, F373P, F373Q, F373R, F373S, F373T, F373V, F373W, F373Y, P385A, P385C, P385D, P385E, P385F, P385G, P385H, P385I, P385K, P385L, P385M, P385N, P385Q, P385R, P385S, P385T, P385V, P385W, and P385Y, wherein the amino acid positions of the polypeptide sequence are numbered with reference to SEQ ID NO: 868.

In some additional embodiments, the recombinant lipase comprises at least one mutation in at least one position as provided in Tables 4-1, 4-2, 4-3, 4-4, 4-5, 4-6, 4-7, and/or 5-1, wherein the positions are numbered with reference to SEQ ID NO: 2, 94, 350, 442, 540, 646, 758, and/or 868. In some further embodiments, the recombinant lipase comprises a polypeptide sequence having at least about 85%, about 86%, about 87%, about 88%, about 89%, about 90%, about 91%, about 92%, about 93%, about 94%, about 95%, about 96%, about 97%, about 98%, about 99%, or more sequence identity to at least one sequence set forth in the even-numbered sequences of SEQ ID NOS: 14-1796. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to at least one sequence set forth in the even-numbered sequences of SEQ ID NOS: 14-1796. In some additional embodiments, the recombinant lipase comprises at least one sequence set forth in the even-numbered sequences of SEQ ID NOS: 14-1796.

In some additional embodiments, the recombinant lipase is more thermostable than the lipase of SEQ ID NO: 2. In some further embodiments, the recombinant lipase is more thermostable than the lipase of SEQ ID NO: 94, 350, 442, 540, 646, 758, and/or 868. In some embodiments, the recombinant lipase retains enzymatic activity after exposure to high and/or low temperatures. In some additional embodiments, the recombinant lipase retains more enzymatic activity after exposure to high and/or low temperatures, as compared to a reference sequence. In some embodiments, the reference sequence is wild-type lipase, while in some other embodiments, the reference sequence is another recombinant lipase.

In some embodiments, the recombinant lipase is stable and/or active in low pH environments, while in other embodiments, the recombinant lipase is stable and/or active in high pH environments, and in still further embodiments, the recombinant lipase is stable and/or active in neutral pH environments. In some embodiments, the recombinant lipase is stable and/or active in low and high pH environments, and in some additional embodiments, the lipase is stable and/or active in low, neutral and high pH environments. In some embodiments, the recombinant lipase retains enzymatic activity after exposure to a low, high, and/or neutral pH environment. In some additional embodiments, the recombinant lipase is more stable and/or active at high, neutral, and/or low pH environment(s), as compared to a reference sequence. In some embodiments, the reference sequence is wild-type lipase, while in other embodiments, the reference sequence is another engineered lipase. In some further embodiments, the recombinant lipase is more stable and/or active at pHs less than 7 (i.e., under acidic pH conditions or levels), than the lipase of SEQ ID NO: 2. In some additional embodiments, the recombinant lipase is more stable and/or active at pHs less than pH 7 (i.e., under acidic pH conditions or levels), than the lipase of SEQ ID NO: 94, 350, 442, 540, 646, 758, and/or 868. In some further embodiments, the recombinant lipase is more stable and/or active at pHs less than 5, than the lipase of SEQ ID NO: 2. In some additional embodiments, the recombinant lipase is more stable and/or active at pH 5, than the lipase of SEQ ID NO: 2. In some additional embodiments, the recombinant lipase is more stable and/or active at pH 5, than the lipase of SEQ ID NO: 94, 350, 442, 540, 646, 758, and/or 688. In some further embodiments, the recombinant lipase is more and/or active stable at pH 3.5, than the lipase of SEQ ID NO: 2. In some further embodiments, the recombinant lipase is more stable and/or active at pH 3.5, than the lipase of SEQ ID NO: 94, 350, 442, 540, 646, 758, and/or 868. In some further embodiments, the recombinant lipase is more stable and/or active at pH 3, than the lipase of SEQ ID NO: 2. In some further embodiments, the recombinant lipase is more stable and/or active at pH 3, than the lipase of SEQ ID NO: 94, 350, 442, 540, 646, 758, and/or 868. In some embodiments, the recombinant lipase is more resistant to proteolysis than the lipase of SEQ ID NO: 2. In some embodiments, the recombinant lipase is more resistant to proteolysis than the lipase of SEQ ID NO: 94, 350, 442, 540, 646, 758, and/or 868. In some additional embodiments, the recombinant lipase is resistant to proteolysis by trypsin. In some additional embodiments, the recombinant lipase is more resistant to proteolysis by trypsin than the lipase of SEQ ID NO: 2. In some embodiments, the recombinant lipase is more resistant to proteolysis by trypsin than the lipase of SEQ ID NO: 94, 350, 442, 540, 646, 758, and/or 868. In some embodiments, the recombinant lipase is resistant to proteolysis by chymotrypsin. In some additional embodiments, the recombinant lipase is more resistant to proteolysis by chymotrypsin than the lipase of SEQ ID NO: 2. In some embodiments, the recombinant lipase is more resistant to proteolysis by chymotrypsin than the lipase of SEQ ID NO: 94, 350, 442, 540, 646, 758, and/or 868. In some further embodiments, the recombinant lipase is resistant to proteolysis by pepsin, trypsin, and/or chymotrypsin. In some additional embodiments, the recombinant lipase is more resistant to proteolysis by pepsin, trypsin, and/or chymotrypsin, than the lipase of SEQ ID NO: 2. In some embodiments, the recombinant lipase is more resistant to proteolysis by pepsin, trypsin, and/or chymotrypsin, than the lipase of SEQ ID NO: 94, 350, 442, 540, 646, 758, and/or 868.

In some additional embodiments, the recombinant lipase is more active in the presence of at least one bile salt than the lipase of SEQ ID NO: 2. In some additional embodiments, the recombinant lipase is more active in the presence of at least one bile salt than the lipase of SEQ ID NO: 94, 350, 442, 540, 646, 758, and/or 868. In some embodiments, the recombinant lipase retains enzymatic activity after exposure to a bile salt. In some additional embodiments, the recombinant lipase retains more enzymatic activity after exposure to a bile salt, as compared to a reference sequence. In some embodiments, the reference sequence is the lipase of SEQ ID NO: 2, 94, 350, 442, 540, 646, 758, and/or 868. In some additional embodiments, the bile salt is taurocholate.

In yet some additional embodiments, the recombinant lipase is more stable and/or active at acidic pHs, more thermostable, more resistant to proteolysis, and/or more active in the presence of at least one bile salt than the lipase of SEQ ID NO: 2. In still some further embodiments, the lipase is stable in food and/or beverages. In yet some additional embodiments, the recombinant lipase is more stable and/or active at acidic pHs, more thermostable, more resistant to proteolysis, and/or more active in the presence of at least one bile salt than the lipase of SEQ ID NO: 94, 350, 442, 540, 646, 758, and/or 868. In some embodiments, the recombinant lipase exhibits at least one improved property selected from improved stability and/or activity at acidic pHs, improved thermostability, improved resistance to proteolysis, and/or improved activity in the presence of at least one bile salt, as compared to the lipase of SEQ ID NO: 2. In some embodiments, the recombinant lipase exhibits at least one improved property selected from improved stability and/or activity at acidic pHs, improved thermostability, improved resistance to proteolysis, and/or improved activity in the presence of at least one bile salt, as compared to the lipase of SEQ ID NO: 94, 350, 442, 540, 646, 758, and/or 868. In some embodiments, the recombinant lipase exhibits at least two improved properties selected from improved stability and/or activity at acidic pHs, improved thermostability, improved resistance to proteolysis, and/or improved activity in the presence of at least one bile salt, as compared to the lipase of SEQ ID NO: 2. In some embodiments, the recombinant lipase exhibits at least two improved properties selected from improved stability and/or activity at acidic pHs, improved thermostability, improved resistance to proteolysis, and/or improved activity in the presence of at least one bile salt, as compared to the lipase of SEQ ID NO: 94, 350, 442, 540, 646, 758, and/or 868. In some embodiments, the recombinant lipase exhibits at least three improved properties selected from improved stability and/or activity at acidic pHs, improved thermostability, improved resistance to proteolysis, and/or improved activity in the presence of at least one bile salt, as compared to the lipase of SEQ ID NO: 2. In some embodiments, the recombinant lipase exhibits at least three improved properties selected from improved stability and/or activity at acidic pHs, improved thermostability, improved resistance to proteolysis, and/or improved activity in the presence of at least one bile salt, as compared to the lipase of SEQ ID NO: 94, 350, 442, 540, 646, 758, and/or 868. In some embodiments, the recombinant lipase exhibits the improved properties of improved stability and/or activity at acidic pHs, improved thermostability, improved resistance to proteolysis, and improved activity in the presence of at least one bile salt, as compared to the lipase of SEQ ID NO: 2. In some embodiments, the recombinant lipase exhibits the improved properties of improved stability and/or activity at acidic pHs, improved thermostability, improved resistance to proteolysis, and/or improved activity in the presence of at least one bile salt, as compared to the lipase of SEQ ID NO: 94, 350, 442, 540, 646, 758, and/or 868. In some embodiments, the recombinant lipase exhibits at least one improved property selected from improved stability and/or activity at acidic pHs, improved thermostability, improved resistance to proteolysis, and/or improved activity in the presence of at least one bile salt, as well as at least one additional improved property, as compared to the lipase of SEQ ID NO: 2. In some embodiments, the recombinant lipase exhibits at least one improved property selected from improved stability and/or activity at acidic pHs, improved thermostability, improved resistance to proteolysis, and/or improved activity in the presence of at least one bile salt, as well as at least one additional improved property, as compared to the lipase of SEQ ID NO: 94, 350, 442, 540, 646, 758, and/or 868. In some embodiments, the recombinant lipase exhibits at least one improved property selected from: i) enhanced catalytic activity; ii) increased tolerance to acid pH; iii) increased tolerance to pH 3.5; iv) increased tolerance to pH 3; v) increased tolerance to at least one protease; vi) increased tolerance to at least one bile salt; vii) increased thermotolerance; or a combination of any of i), ii), iii), iv), v), vi), and vii) as compared to a reference sequence. In some embodiments, the reference sequence is SEQ ID NO: 2, while in some alternative embodiments, the reference sequence is selected from SEQ ID NO: 94, 350, 442, 540, 646, 758, and 868. In some embodiments, the recombinant lipase exhibits at least one improved property selected from: i) enhanced catalytic activity; ii) increased tolerance to acid pH; iii) increased tolerance to pH 3.5; iv) increased tolerance to pH 3; v) increased tolerance to at least one protease; vi) increased tolerance to at least one bile salt; vii) increased thermotolerance; or a combination of any of i), ii), iii), iv), v), vi), and vii) as compared to at least one reference sequence. In some embodiments, the reference sequence is SEQ ID NO: 2, while in some alternative embodiments, the reference sequence is selected from SEQ ID NO: 94, 350, 442, 540, 646, 758, and 868. In some embodiments, the recombinant lipase exhibits at least one improved property selected from: i) enhanced catalytic activity; ii) increased tolerance to acid pH; iii) increased tolerance to pH 3.5; iv) increased tolerance to pH 3; v) increased tolerance to at least one protease; vi) increased tolerance to at least one bile salt; vii) increased thermotolerance; or a combination of any of i), ii), iii), iv), v), vi), and vii) as compared to at least two or more reference sequences. In some embodiments, the protease is selected from pepsin, trypsin, and/or chymotrypsin. In some embodiments, the reference sequence is selected from SEQ ID NOS: 2, 94, 350, 442, 540, 646, 758, and 868. In some further embodiments, the recombinant lipase is purified.

The present invention also provides recombinant polynucleotide sequences encoding at least one recombinant lipase provided herein. In some embodiments, the recombinant polynucleotide sequence is codon-optimized. In some further embodiments, the recombinant polynucleotide comprises a sequence having at least about 85%, about 86%, about 87%, about 88%, about 89%, about 90%, about 91%, about 92%, about 93%, about 94%, about 95%, about 96%, about 97%, about 98%, about 99%, or more sequence identity to at least one sequence set forth in the odd-numbered sequences of SEQ ID NOS: 13-1795. In some further embodiments, the polynucleotide comprises a sequence having at least 85%, 86%, 87%, 88%, 89%, 90%, 91%, 92%, 93%, 94%, 95%, 96%, 97%, 98%, 99%, or more sequence identity to at least one sequence set forth in the odd-numbered sequences of SEQ ID NOS: 13-1795. In some additional embodiments, the present invention provides at least one sequence set forth in the odd-numbered sequences of SEQ ID NOS: 13-1795. In some additional embodiments, the recombinant polynucleotide sequence comprises a sequence selected from the odd-numbered sequences of SEQ ID NOS: 13-1795. In some embodiments, the recombinant polynucleotide sequence comprises a sequence selected from the odd-numbered sequences of SEQ ID NOS: 13-1795, wherein said sequence encodes a recombinant polypeptide provided herein. In some embodiments, the recombinant polynucleotide sequence comprises a sequence selected from the odd-numbered sequences of SEQ ID NOS: 13-1795, wherein said sequence encodes a recombinant polypeptide provided in an even-numbered sequence provided in SEQ ID NO: 14-1796. In some further embodiments, the recombinant polynucleotide encoding a recombinant lipase provided herein comprises a sequence having at least about 85%, about 86%, about 87%, about 88%, about 89%, about 90%, about 91%, about 92%, about 93%, about 94%, about 95%, about 96%, about 97%, about 98%, about 99%, or more sequence identity to at least one sequence set forth in the odd-numbered sequences of SEQ ID NOS: 13-1795. In some further embodiments, the recombinant polynucleotide encoding a recombinant lipase provided herein comprises a sequence having at least 85%, 86%, 87%, 88%, 89%, 90%, 91%, 92%, 93%, 94%, 95%, 96%, 97%, 98%, 99%, or more sequence identity to at least one sequence set forth in the odd-numbered sequences of SEQ ID NOS: 13-1795. In some further embodiments, the recombinant polynucleotide encoding a recombinant lipase provided herein comprises a sequence having at least 85%, 86%, 87%, 88%, 89%, 90%, 91%, 92%, 93%, 94%, 95%, 96%, 97%, 98%, 99%, or more sequence identity to at least one sequence set forth in the odd-numbered sequences of SEQ ID NOS: 13-1795, wherein the recombinant lipase comprises a polypeptide sequence comprising an even-numbered sequence provided in SEQ ID NOS: 14-1796.

The present invention also provides expression vectors comprising at least one recombinant polynucleotide sequence provided herein. The present invention also provides expression vectors comprising at least one recombinant polynucleotide sequence encoding at least one recombinant lipase provided herein. In some additional embodiments, the recombinant polynucleotide sequence is operably linked to a control sequence. In some embodiments, the control sequence is a promoter. In some further embodiments, the promoter is a heterologous promoter.

The present invention also provides host cells comprising at least one expression vector provided herein. The present invention also provides host cells comprising at least one expression vector comprising at least one recombinant polynucleotide sequence encoding at least one recombinant lipase provided herein. The present invention also provides host cells comprising an expression vector comprising at least one recombinant polynucleotide sequence encoding at least one recombinant lipase provided herein. The present invention also provides host cells comprising an expression vector comprising at least one recombinant polynucleotide sequence encoding a recombinant lipase provided herein. In some embodiments, the host cell is eukaryotic, while in some alternative embodiments, the host cell is prokaryotic. In some embodiments, the host cell is *Escherichia coli*. In some alternative embodiments, the host cell is *Saccharomyces cerevisiae*.

The present invention also provides methods of producing at least one recombinant lipase, comprising culturing at least one host cell provided herein, under conditions that the recombinant lipase encoded by the recombinant polynucleotide is produced. In some embodiments, the methods further comprise the step of recovering the lipase. In yet some additional embodiments, the methods further comprise the step of purifying the lipase.

The present invention also provides compositions comprising at least one recombinant lipase provided herein. In some embodiments, the composition comprising at least one recombinant lipase comprises a pharmaceutical composition. In some additional embodiments, the pharmaceutical composition is suitable for the treatment of pancreatic insufficiency. In some additional embodiments, the pharmaceutical composition further comprising a pharmaceutically acceptable carrier and/or excipient. In some embodiments, the pharmaceutical composition is suitable for parenteral injection or infusion to a human. In some additional embodiments, the pharmaceutical composition is suitable for oral administration to a human. In some further embodiments, the pharmaceutical composition is suitable for other modes of administration to a human. The present invention also provides compositions comprising at least one recombinant lipase provided herein, wherein the compositions are suitable for other uses.

The present invention also provides methods for treating and/or preventing the symptoms of pancreatic insufficiency in a subject, comprising providing a subject having pancreatic insufficiency, and providing the pharmaceutical composition provided herein to the subject. In some embodiments, the symptoms of pancreatic insufficiency are ameliorated in a subject, upon the administration of the composition comprising at least one recombinant lipase to the subject. In some additional embodiments, the pharmaceutical composition further comprises at least one protease. In some further embodiments, the pharmaceutical composition further comprises at least one amylase. In yet some additional embodiments, the pharmaceutical composition further comprises at least one protease and at least one amylase.

In some further embodiments, the subject is able to eat a diet that is less restricted in its lipid content than diets required by subjects exhibiting the symptoms of pancreatic insufficiency. In some additional embodiments, the subject is an infant, while in some other embodiments, the subject is a child. In yet some further embodiments, the subject is an adult, while in some alternative embodiments, the subject is a young adult. The present invention further provides medicaments comprising at least one recombinant lipase provided herein.

In some embodiments, the present invention provides methods for breaking down fats and/or lipids, comprising providing at least one fat and/or lipid and at least one engineered lipase of the present invention, and exposing the fat and/or lipid to at least one engineered amylase under conditions that the fat and/or lipid are broken down. In some additional embodiments, the present invention provides methods for breaking down fats and/or lipids, comprising providing at least one fat and/or lipid and a composition comprising at least one engineered lipase of the present invention, and exposing the fat and/or lipid to the composition comprising at least one engineered amylase under conditions that the fat and/or lipid are broken down. The present invention also provides for use of the compositions comprising at least one recombinant lipase provided herein. The present invention provides methods for fat and/or lipid hydrolysis, comprising providing fat and/or lipid and at least one engineered lipase provided herein; and exposing said fat and/or lipid to said engineered lipase under conditions such that said fat and/or lipid is hydrolyzed by said engineered amylase. In some further embodiments, the present invention provides methods for fat and/or lipid hydrolysis, comprising providing fat and/or lipid and the composition comprising at least one engineered lipase provided herein; and exposing said fat and/or lipid to said composition under conditions such that said fat and/or lipid is hydrolyzed by said engineered lipase of said composition.

DESCRIPTION OF THE INVENTION

The present invention provides engineered lipase polypeptides and compositions thereof. The engineered lipase polypeptides have been optimized to provide improved thermostability, protease stability, and stability under a range of pH conditions, including acidic (pH<7) conditions. The invention also relates to the use of the compositions comprising the engineered lipase polypeptides for therapeutic purposes. In some embodiments, the lipase variants of the present invention find use in PERT treatment of PEI conditions. In some additional embodiments, the lipase is administered in formats that do not require an enteric coating and/or proton-pump inhibitors (PPIs). The present invention also provides polynucleotides encoding the engineered lipase polypeptides, as well as methods for making the engineered polynucleotides and lipase polypeptides.

Abbreviations and Definitions:

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, biochemistry, organic chemistry, analytical chemistry and nucleic acid chemistry described below are those well-known and commonly employed in the art. Such techniques are well-known and described in numerous texts and reference works well known to those of skill in the art. Standard techniques, or modifications thereof, are used for chemical syntheses and chemical analyses. All patents, patent applications, articles and publications mentioned herein, both supra and infra, are hereby expressly incorporated herein by reference.

Although any suitable methods and materials similar or equivalent to those described herein find use in the practice of the present invention, some methods and materials are described herein. It is to be understood that this invention is not limited to the particular methodology, protocols, and reagents described, as these may vary, depending upon the context they are used by those of skill in the art. Accordingly, the terms defined immediately below are more fully described by reference to the application as a whole. All patents, patent applications, articles and publications mentioned herein, both supra and infra, are hereby expressly incorporated herein by reference.

As used herein, the singular "a", "an," and "the" include the plural references, unless the context clearly indicates otherwise.

Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

The term "about" means an acceptable error for a particular value. In some instances "about" means within 0.05%, 0.5%, 1.0%, or 2.0%, of a given value range. In some instances, "about" means within 1, 2, 3, or 4 standard deviations of a given value.

Furthermore, the headings provided herein are not limitations of the various aspects or embodiments of the invention which can be had by reference to the application as a whole. Accordingly, the terms defined immediately below are more fully defined by reference to the application as a whole. Nonetheless, in order to facilitate understanding of the invention, a number of terms are defined below.

Unless otherwise indicated, nucleic acids are written left to right in 5' to 3' orientation; amino acid sequences are written left to right in amino to carboxy orientation, respectively.

As used herein, the term "comprising" and its cognates are used in their inclusive sense (i.e., equivalent to the term "including" and its corresponding cognates).

As used herein, "EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

As used herein "ATCC" refers to the American Type Culture Collection whose biorepository collection includes genes and strains.

As used herein "NCBI" refers to National Center for Biological Information and the sequence databases provided therein.

As used herein, "lipase" refers to any enzyme commonly referred to as "lipase," that catalyzes the hydrolysis of fats by hydrolyzing the ester bonds of triglycerides. Pancreatic lipases are important in the breakdown of fats to fatty acids, glycerol, and other alcohols. Lipases are essential in the digestion, transport, and processing of dietary lipids in most organisms.

As used herein, the term "lipid" refers to a class of water-insoluble macromolecules that include fatty acids and their esters, sterols, prenols, certain poorly soluble vitamins, and other related compounds. "Fats" are a subset of lipids composed of fatty acid esters (e.g., triglycerides, which are made from glycerol and three fatty acids). It is not intended that the present invention be limited to any specific lipid and/or fat. Taking the context in consideration, the terms "fat" and "lipid" are used interchangeably herein.

As used herein, "protease" (and "proteinase" and "peptidase") refers to the numerous enzymes that hydrolyze proteins. There are numerous proteases involved in the breakdown of proteins into smaller polypeptide unties or single amino acids. Proteases are important for numerous biological functions, including digestion of ingested proteins, protein catabolism, and cell signaling.

"Protein," "polypeptide," and "peptide" are used interchangeably herein to denote a polymer of at least two amino acids covalently linked by an amide bond, regardless of length or post-translational modification (e.g., glycosylation or phosphorylation).

"Amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes.

The term "engineered," "recombinant," "non-naturally occurring," and "variant," when used with reference to a cell, a polynucleotide or a polypeptide refers to a material or a material corresponding to the natural or native form of the material that has been modified in a manner that would not otherwise exist in nature or is identical thereto but produced or derived from synthetic materials and/or by manipulation using recombinant techniques.

Recombinant polypeptides can be produced using any suitable methods known the art. Genes encoding the wild-type polypeptide of interest can be cloned in vectors, such as plasmids, and expressed in desired hosts, such as E. coli, S. cerevisiae, etc. Variants of recombinant polypeptides can be generated by various methods known in the art. Indeed, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Non-limiting examples of methods used for DNA and protein engineering are provided in the following patents: U.S. Pat. Nos. 6,117,679; 6,420,175; 6,376,246; 6,586,182; 7,747,391; 7,747,393; 7,783,428; and 8,383,346. After the variants are produced, they can be screened for any desired property (e.g., high or increased activity, or low or reduced activity, increased thermal activity, increased thermal stability, and/or acidic pH stability, etc.). In some embodiments, "recombinant lipase polypeptides" (also referred to herein as "engineered lipase polypeptides," "variant lipase enzymes," and "lipase variants") find use.

As used herein, "wild-type" and "naturally-occurring" refer to the form found in nature. For example, a wild-type polypeptide or polynucleotide sequence is a sequence present in an organism that can be isolated from a source in nature and which has not been intentionally modified by human manipulation.

As used herein, "coding sequence" refers to that part of a nucleic acid (e.g., a gene) that encodes an amino acid sequence of a protein.

The term "percent (%) sequence identity" is used herein to refer to comparisons among polynucleotides and polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted, e.g., by the local homology algorithm of Smith and Waterman (Smith and Waterman, Adv. Appl. Math., 2:482 [1981]), by the homology alignment algorithm of Needleman and Wunsch (Needleman and Wunsch, J. Mol. Biol., 48:443 [1970], by the search for similarity method of Pearson and Lipman (Pearson and Lipman, Proc. Natl. Acad. Sci. USA 85:2444 [1988]), by computerized implementations of these algorithms (e.g., GAP, BESTFIT, FASTA, and TFASTA in the GCG Wisconsin Software Package), or by visual inspection, as known in the art. Examples of algorithms that are suitable for determining percent sequence identity and sequence similarity include, but are not limited to the BLAST and BLAST 2.0 algorithms, which are described by Altschul et al. (See, Altschul et al., J. Mol. Biol., 215: 403-410 [1990]; and Altschul et al., Nucleic Acids Res., 3389-3402 [1977], respectively). Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (See, Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (See, Henikoff and Henikoff, Proc. Natl. Acad. Sci. USA 89:10915 [1989]). Exemplary determination of sequence alignment and % sequence identity can employ the BESTFIT or GAP programs in the GCG Wisconsin Software package (Accelrys, Madison WI), using default parameters provided.

As used herein, "reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, at least 100 residues in length or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence. "Comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

"Corresponding to", "reference to" or "relative to" when used in the context of the numbering of a given amino acid or polynucleotide sequence refers to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered lipase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

As used herein, "mutation" refers to any change in a polypeptide or polynucleotide sequence. It is intended to encompass any number (i.e., one or more) of substitutions, insertions, deletions, and/or rearrangements present in a sequence (i.e., as compared to the starting or reference sequence). Thus, mutations in sequences result in the production of variant polypeptides (e.g., variant or recombinant lipases), as provided herein.

As used herein, "amino acid difference" or "residue difference" refers to a difference in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X92 as compared to SEQ ID NO: 2" refers to a difference of the amino acid residue at the polypeptide position corresponding to position 92 of SEQ ID NO: 2. Thus, if the reference polypeptide of SEQ ID NO: 2 has a threonine at position 92, then a "residue difference at position X92 as compared to SEQ ID NO:2" means there is an amino acid residue other than threonine at the position of the polypeptide corresponding to position 92 of SEQ ID NO: 2 (e.g., T92A). In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some instances (e.g., in Table 4-1, 4-2, 4-3, 4-4, 4-5, 4-6, 4-7, and/or 5-1), the present disclosure also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present disclosure can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X2H/X2M/X2T or X2H/M/T or E2H/M/T). In some embodiments, the enzyme variants comprise more than one substitution. These substitutions are separated by a slash for ease in reading (e.g., Y27V/F385P). The present application includes engineered polypeptide sequences comprising one or more amino acid differences that include either/or both conservative and non-conservative amino acid substitutions.

As used herein, "conservative amino acid substitution" refers to a substitution of a residue with a different residue having a similar side chain, and thus typically involves substitution of the amino acid in the polypeptide with amino acids within the same or similar defined class of amino acids. By way of example and not limitation, an amino acid with an aliphatic side chain may be substituted with another aliphatic amino acid (e.g., alanine, valine, leucine, and isoleucine); an amino acid with hydroxyl side chain is substituted with another amino acid with a hydroxyl side chain (e.g., serine and threonine); an amino acids having aromatic side chains is substituted with another amino acid having an aromatic side chain (e.g., phenylalanine, tyrosine, tryptophan, and histidine); an amino acid with a basic side chain is substituted with another amino acid with a basis side chain (e.g., lysine and arginine); an amino acid with an acidic side chain is substituted with another amino acid with an acidic side chain (e.g., aspartic acid or glutamic acid); and/or a hydrophobic or hydrophilic amino acid is replaced with another hydrophobic or hydrophilic amino acid, respectively.

As used herein, "non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

As used herein, "deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered enzyme. Deletions can be directed to the internal portions and/or terminal portions of the polypeptide. In various embodiments, the deletion can comprise a continuous segment or can be discontinuous.

As used herein, "insertion" refers to modification to the polypeptide by addition of one or more amino acids from the reference polypeptide. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

As used herein, an asterisk (*) used in the context of a polynucleotide sequence indicates the presence of a stop codon within the polynucleotide sequence. In some embodiments, the variant proteases are truncated, as compared to the starting or reference sequence, due to the presence of stop codons.

A "functional fragment" and a "biologically active fragment" are used interchangeably herein refers to a polypeptide that has an amino-terminal and/or carboxy-terminal deletion(s) and/or internal deletions (e.g., the sequence is truncated), but where the remaining amino acid sequence is identical to the corresponding positions in the sequence to which it is being compared (e.g., a full-length engineered lipase of the present invention) and that retains substantially all of the activity of the full-length polypeptide.

As used herein, "isolated polypeptide" refers to a polypeptide that is substantially separated from other contaminants that naturally accompany it (e.g., protein, lipids, and polynucleotides). The term embraces polypeptides that have been removed or purified from their naturally-occurring environment or expression system (e.g., host cell or in vitro synthesis). The recombinant lipase polypeptides may be present within a cell, present in the cellular medium, or prepared in various forms, such as lysates or isolated preparations. As such, in some embodiments, the recombinant lipase polypeptides can be an isolated polypeptide.

The terms "isolated" and "purified" are used to refer to a molecule (e.g., an isolated nucleic acid, polypeptide, etc.) or other component that is removed from at least one other component with which it is naturally associated. The term "purified" does not require absolute purity, rather it is intended as a relative definition.

As used herein, "substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure lipase composition comprises about 60% or more, about 70% or more, about 80% or more, about 90% or more, about 95% or more, and about 98% or more of all macromolecular species by mole or % weight present in the composition. In some embodiments, the object species is purified from a starting preparation to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated recombinant lipase polypeptides are substantially pure polypeptide compositions. In some embodiments, the isolated recombinant lipase polypeptides are substantially pure polypeptide compositions. In some embodiments, substantially pure recombinant lipase polypeptide preparations added to formulations suitable for use in the present invention (e.g., polysaccharides, surfactants, etc.).

As used herein, the terms "improved enzyme property" and "improved property" refer to a property of an engineered lipase polypeptide, which comprises an improvement in any enzyme property as compared to a reference lipase polypeptide and/or as a wild-type lipase polypeptide or another engineered lipase polypeptide. Improved properties include but are not limited to such properties as increased protein expression, increased thermoactivity, increased thermostability, increased pH activity, increased stability, increased enzymatic activity, increased substrate specificity or affinity, increased specific activity, increased resistance to substrate or end-product inhibition, increased chemical stability, improved chemoselectivity, improved solvent stability, increased tolerance to acidic or basic pH, increased tolerance to proteolytic activity (i.e., reduced sensitivity to proteolysis), reduced aggregation, increased solubility, reduced immunogenicity, improved post-translational modification (e.g., glycosylation), and altered temperature profile.

As used herein, "increased enzymatic activity" or "enhanced catalytic activity" refers to an improved property of the engineered lipase polypeptide that can be represented by an increase in specific activity (e.g., product produced/time/weight protein) or an increase in percent conversion of the substrate to the product (e.g., percent conversion of starting amount of substrate to product in a specified time period using a specified amount of lipase) as compared to the reference lipase enzyme. Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. Improvements in enzyme activity can be from about 1.1 fold the enzymatic activity of the corresponding wild-type enzyme, to as much as 2-fold, 5-fold, 10-fold, 20-fold, 25-fold, 50-fold, 75-fold, 100-fold, 150-fold, 200-fold or more enzymatic activity than the naturally occurring lipase or another engineered lipase from which the lipase polypeptides were derived.

Lipase activity can be measured by any suitable method known in the art (e.g., standard assays, such as monitoring changes in spectrophotometric properties of reactants or products). In some embodiments, the amount of products produced can be measured by High-Performance Liquid Chromatography (HPLC) separation combined with UV absorbance In some embodiments, the amount of products produced can be measured using a RAPIDFIRE® mass spectrometer, while in some other embodiments, the products can be measured using alternative methods known in the art. Comparisons of enzyme activities are made using a defined preparation of enzyme, a defined assay under a set condition, and one or more defined substrates, as further described in detail herein.

As used herein, the terms "protease stable" and "stability to proteolysis" refer to the ability of a protein (e.g., a recombinant lipase of the present invention) to function and withstand proteolysis mediated by any proteolytic enzyme or other proteolytic compound or factor and retain its function following exposure to a protease. It is not intended that the term be limited to the use of any particular protease to assess the stability of a protein. Indeed, the engineered lipases of the present invention are stable and retain enzymatic activity in the presence of or following exposure to various proteases. In some embodiments, the engineered lipases are stable in the presence of trypsin, chymotrypsin, and/or pepsin. However, it is not intended that the present invention be limited to any specific protease or any particular method of assessing proteolytic stability.

As used herein, the term "pH stability" refers to the ability of a protein (e.g., a recombinant lipase of the present invention) to function after incubation at a particular pH. In some embodiments, the present invention provides recombinant lipases that are stable at a range of pHs, including, but not limited to the range of pH 2 to pH 7. In some embodiments, the recombinant lipases are stable at different pH ranges, as indicated in the Examples provided herein. It is not intended that the present invention be limited to any pH stability level nor pH range.

As used herein, the term "improved tolerance to acidic pH" means that a recombinant lipase according to the invention will have increased stability (higher retained activity at about pH 7, 6, 5, 4, 3, 2, or even lower, after exposure to acidic pH for a specified period of time [e.g., 1 hour, up to 24 hours, etc.]) as compared to a reference lipase or another enzyme.

"Physiological pH" as used herein means the pH range generally found in a subject's (e.g., human) blood (e.g., pH 7.2-7.4).

The term "basic pH" (e.g., used with reference to improved stability to basic pH conditions or increased tolerance to basic pH) means a pH range of about 7 to 11, or in some embodiments, greater than pH 11.

The term "acidic pH" (e.g., used with reference to improved stability to acidic pH conditions or increased tolerance to acidic pH) means a pH range that encompasses any pH values less than 7. In some embodiments, the acid pH is less than 7, while in some other embodiments, the pH is less than about 6, 5, 4, 3, 2, or lower. In some alternative embodiments, the recombinant lipases of the present invention are stable at pH levels of 2 to 4. However, it is not intended that the present invention be limited to any specific pH value or range of values.

As used herein, the phrase "gastric challenge" refers to the exposure of the recombinant lipases of the present invention to a low pH environment and the presence of at least one enzyme (e.g., pepsin), such that the recombinant lipase is exposed to conditions that may be encountered in the stomach (e.g., the human stomach).

As used herein, the phrase "intestinal challenge" refers to the exposure of the recombinant lipases of the present invention to a neutral pH environment and the presence of intestinal proteases such as trypsin and chymotrypsin, and at least one bile salt (e.g., sodium taurocholate), such that the recombinant lipase is exposed to conditions that may be encountered in the intestinal tract (e.g., human intestines).

As used herein, the phrase "multiple challenges in sequence" refers to the exposure of the recombinant lipases of the present invention to a series of challenge conditions. For example, in some embodiments, a one hour heat challenge was followed by a one hour gastric challenge, and then followed by a one hour intestinal challenge. It is not intended that the present invention be limited to any specific challenges and/or challenge conditions or a specific sequence of challenges.

The terms "thermal stability" and "thermostability" refer to the ability of a protein (e.g., a recombinant lipase of the present invention) to function at a particular temperature. In some embodiments, the term refers to the ability of a protein to function following incubation at a particular temperature. In some embodiments, the recombinant lipases of the present invention are "thermotolerant" (i.e., the enzymes maintain their catalytic activity at elevated temperatures). In some embodiments, the recombinant lipases resist inactivation at elevated temperatures, and in some additional embodiments, maintain catalytic activity at elevated temperatures for prolonged exposure times. These terms are used interchangeably herein. It is not intended that the present invention be limited to any specific temperature and/or exposure time. Such stability can be measured by any method known in the art (e.g., the methods described herein). It is not intended that the present invention be limited to any specific temperature stability level nor temperature range. In some embodiments, thermal stability is measured following incubation of a protein (e.g., a recombinant lipase of the present invention) at a particular temperature.

The term "chemical stability" refers to the ability of a protein (e.g., a recombinant lipase of the present invention) to function in the presence of a chemical that adversely affects the function of another protein. It is not intended that the present invention be limited to any specific chemical stability level nor range of chemical stabilities.

"Conversion" refers to the enzymatic conversion (or biotransformation) of a substrate(s) to the corresponding product(s). "Percent conversion" refers to the percent of the substrate that is converted to the product within a period of time under specified conditions. Thus, the "enzymatic activity" or "activity" of a lipase polypeptide can be expressed as "percent conversion" of the substrate to the product in a specific period of time.

As used herein, "hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5× Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5× Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w/v) SDS at 65° C. and washing in 0.1×SSC containing 0.1% SDS at 65° C. Other high stringency hybridization conditions, as well as moderately stringent conditions, are described in the references cited above.

As used herein, a "vector" is a DNA construct for introducing a DNA sequence into a cell. In some embodiments, the vector is an expression vector that is operably linked to a suitable control sequence capable of effecting the expression in a suitable host of the polypeptide encoded in the DNA sequence. In some embodiments, plasmids find use as vectors. In some embodiments, an "expression vector" has a promoter sequence operably linked to the DNA sequence (e.g., transgene) to drive expression in a host cell, and in some embodiments, also comprises a transcription terminator sequence.

As used herein, "codon optimized" refers to changes in the codons of the polynucleotide encoding a protein to those preferentially used in a particular organism such that the encoded protein is more efficiently expressed in the organism of interest. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the lipase enzymes may be codon optimized for optimal production from the host organism selected for expression.

As used herein, "control sequence" refers herein to all components that are necessary or advantageous for the expression of a polynucleotide and/or polypeptide of the present application. Each control sequence may be native or foreign to the nucleic acid sequence encoding the polypeptide. Such control sequences include, but are not limited to, a leader, polyadenylation sequence, propeptide sequence, promoter sequence, signal peptide sequence, initiation sequence and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

"Operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

As used herein, "promoter sequence" refers to a nucleic acid sequence that is recognized by a host cell for expression of a polynucleotide of interest, such as a coding sequence. The promoter sequence contains transcriptional control sequences, which mediate the expression of a polynucleotide of interest. The promoter may be any nucleic acid sequence that shows transcriptional activity in the host cell of choice including mutant, truncated, and hybrid promoters, and may be obtained from genes encoding extracellular or intracellular polypeptides either homologous or heterologous to the host cell.

As used herein, the phrase "suitable reaction conditions" refers to those conditions in the enzymatic conversion reaction solution (e.g., ranges of enzyme loading, substrate loading, temperature, pH, buffers, co-solvents, etc.) under which a lipase polypeptide of the present application is capable of converting a substrate to the desired product compound, Exemplary "suitable reaction conditions" are provided in the present application and illustrated by the Examples.

As used herein, "loading", such as in "compound loading" or "enzyme loading" refers to the concentration or amount of a component in a reaction mixture at the start of the reaction.

As used herein, the term "substrate" used in the context of an enzymatic conversion reaction process refers to the compound or molecule acted on by the lipase polypeptide.

As used herein, the term "product" used in the context of an enzymatic conversion process refers to the compound or molecule resulting from the action of the lipase polypeptide on a substrate.

As used herein, the term "expression" includes any step involved in the production of the polypeptide including, but not limited to, transcription, post-transcriptional modification, translation, and post-translational modification. In some embodiments, the term also encompasses secretion of the polypeptide from a cell.

As used herein, the term "produces" refers to the production of proteins and/or other compounds by cells. It is intended that the term encompass any step involved in the production of polypeptides including, but not limited to, transcription, post-transcriptional modification, translation, and post-translational modification. In some embodiments, the term also encompasses secretion of the polypeptide from a cell.

As used herein, an amino acid or nucleotide sequence (e.g., a promoter sequence, signal peptide, terminator sequence, etc.) is "heterologous" to another sequence with which it is operably linked if the two sequences are not associated in nature.

As used herein, the terms "host cell" and "host strain" refer to suitable hosts for expression vectors comprising DNA provided herein (e.g., the polynucleotides encoding the lipase variants). In some embodiments, the host cells are prokaryotic or eukaryotic cells that have been transformed or transfected with vectors constructed using recombinant DNA techniques as known in the art.

As used herein, the term "analogue" refers to a polypeptide having more than 70% sequence identity but less than 100% sequence identity (e.g., more than 75%, 78%, 80%, 83%, 85%, 88%, 90%, 91%, 92%, 93%, 94%, 95%, 96%, 97%, 98%, 99% sequence identity) with a reference polypeptide. In some embodiments, analogues comprise polypeptides that contain one or more non-naturally occurring amino acid residues including, but not limited, to homoarginine, ornithine and norvaline, as well as naturally occurring amino acids. In some embodiments, analogues also include one or more D-amino acid residues and non-peptide linkages between two or more amino acid residues.

As used herein, the term "culturing" refers to the growing of a population of cells under any suitable conditions (e.g., using a liquid, gel or solid medium). In some embodiments, the cells are microbial cells (e.g., bacteria), while in some other embodiments, the cells are mammalian cells, insect cells, or cells obtained from another animal. It is not intended that the present invention be limited to culturing of any particular cells or cell types or any specific method of culturing. Indeed, it is intended that the present invention encompass any suitable cell types cultured under any suitable conditions.

The term "therapeutic" refers to a compound that provides beneficial or desirable effects, including medical effects, that is administered to a subject who shows signs or symptoms of pathology.

The term "pharmaceutical composition" refers to a composition suitable for pharmaceutical use in a subject (e.g., human) comprising a pharmaceutically effective amount of an engineered lipase polypeptide encompassed by the invention and an acceptable carrier.

The term "effective amount" means an amount sufficient to produce the desired result. One of general skill in the art may determine what the effective amount by using routine experimentation.

The term "subject" encompasses animals, including but not limited to mammals such as humans, non-human primates, livestock, companion animals, and laboratory animals (e.g., rodents and lagamorphs). It is intended that the term encompass females as well as males.

As used herein, the term "patient" means any subject that is being assessed for, treated for, or is experiencing disease.

The term "infant" refers to a child in the period of the first month after birth to approximately one (1) year of age.

As used herein, the term "newborn" refers to child in the period from birth to the 28$^{th}$ day of life. The term "premature infant" refers to an infant born after the twentieth completed week of gestation, yet before full term, generally weighing ~500 to ~2499 grams at birth. A "very low birth weight infant" is an infant weighing less than 1500 g at birth.

As used herein, the term "child" refers to a person who has not attained the legal age for consent to treatment or research procedures. In some embodiments, the term refers to a person between the time of birth and adolescence.

As used herein, the term "adult" refers to a person who has attained legal age for the relevant jurisdiction (e.g., 18 years of age in the United States). In some embodiments, the term refers to any fully grown, mature organism. In some embodiments, the term "young adult" refers to a person less than 18 years of age, but who has reached sexual maturity.

As used herein, "composition" and "formulation" encompass products comprising at least one engineered lipase of the present invention, intended for any suitable use (e.g., pharmaceutical compositions, dietary and/or nutritional supplements, feed, etc.).

As used herein, the terms "administration" and "administering" a composition mean providing a composition of the present invention to a subject (e.g., to a person suffering from the effects of pancreatic insufficiency).

The term "carrier" when used herein in reference to a pharmaceutical composition means any of the standard pharmaceutical carrier, buffers, and excipients, such as stabilizers, preservatives, and adjuvants.

The term "pharmaceutically acceptable" means a material that can be administered to a subject without causing any undesirable biological effects or interacting in a deleterious manner with any of the components in which it is contained and that possesses the desired biological activity.

As used herein, the term "excipient" refers to any pharmaceutically acceptable additive, carrier, diluent, adjuvant, or other ingredient, other than the active pharmaceutical ingredient (API; e.g., the engineered lipase polypeptides of the present invention). Excipients are typically included for formulation and/or administration purposes.

The term "therapeutically effective amount" when used in reference to symptoms of disease/condition refers to the amount and/or concentration of a compound (e.g., engineered lipase polypeptides) that ameliorates, attenuates, or eliminates one or more symptom of a disease/condition or prevents or delays the onset of symptom(s).

The term "therapeutically effective amount" when used in reference to a disease/condition refers to the amount and/or concentration of a composition (e.g., engineered lipase polypeptides) that ameliorates, attenuates, or eliminates the disease/condition. In some embodiments, the term is use in reference to the amount of a composition that elicits the biological (e.g., medical) response by a tissue, system, or animal subject that is sought by the researcher, physician, veterinarian, or other clinician.

As used herein, the terms "treating," "treat," and "treatment" refer to medical care given to a subject (e.g., a human patient), including administration of pharmaceutical compositions, such as those provided herein. It is intended that the terms "treating," "treat" and "treatment" encompass preventative (e.g., prophylactic), as well as palliative treatment or care. In some embodiments, treatment is provided to prevent or ameliorate the symptoms of disease. In some embodiments, the pharmaceutical compositions of the present invention find use in the treatment or prevention of pancreatic enzyme insufficiency disease or conditions.

Engineered Lipases:

The present invention provides engineered lipases suitable for various uses, including treatment of pancreatic enzyme insufficiency. In some embodiments the engineered lipase which exhibits an improved property has at least about 85%, at least about 88%, at least about 90%, at least about 91%, at least about 92%, at least about 93%, at least about 94%, at least about 95%, at least about 96%, at least about 97%, at least about 98%, at least about 99%, or at about 100% amino acid sequence identity with SEQ ID NO: 2, 94, 350, 442, 540, 646, 758, and/or 868, and an amino acid residue difference as compared to SEQ ID NO: 2, 94, 350, 442, 540, 646, 758, and/or 868, at one or more amino acid positions (such as at 1, 2, 3, 4, 5, 6, 7, 8, 9, 10, 11, 12, 14, 15, 20, 21, 22, 23, 24, 25, 26, 27, 28, 29, 30, or more amino acid positions) and/or compared to SEQ ID NO: 2, 94, 350, 442, 540, 646, 758, and/or 868, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 2, 94, 350, 442, 540, 646, 758, and/or 868. In some embodiments, the residue difference as compared to SEQ ID NO: 2, 94, 350, 442, 540, 646, 758, and/or 868, at one or more positions include at least 1, 2, 3, 4, 5, 6, 7, 8, 9, 10, 11, 12, 14, 15, 20, 21, 22, 23, 24, 25, 26, 27, 28, 29, 30, or more conservative amino acid substitutions. However, it is not intended that the present invention be limited to lipase variants with conservative amino acid substitutions, as other substitutions find use in the present invention. In some embodiments, the engineered lipase polypeptide is a polypeptide listed in Table 4-1, 4-2, 4-3, 4-4, 4-5, 4-6, 4-7, and/or 5-1. In some embodiments, the engineered lipase polypeptide comprises SEQ ID NO: 94, 350, 442, 540, 646, 758, and/or 868.

The present invention also provides at least one recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant lipase comprises at least one substitution or substitution set at one or more positions selected from 2, 3, 4, 22, 27/46/97/136/149/385, 27/46/385, 27/70/136/231/385, 27/136/323/385, 27/149, 27/149/385, 27/385, 34, 38, 41, 44, 46/70, 46/149/183/231/385, 48, 70, 73, 73/305, 82, 82/94/101/194/199, 82/94/199, 83, 85, 87, 89, 92, 94, 96, 97/149/385, 135, 136/385, 140, 141, 142, 144, 146, 149, 149/231/385, 151, 174, 175, 178, 181, 183/385, 189, 194, 194/199, 195, 195/231/385, 199, 199/213, 210, 212, 213, 213/330, 216, 218, 219, 226, 231/385, 238, 247, 250, 270, 274, 281, 292, 296, 300, 308, 330, 338, 379, and 385, wherein the amino acid positions of the polypeptide sequence are numbered with reference to SEQ ID NO: 2. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant lipase comprises at least one substitution or substitution set selected from 2H, 2M, 2T, 3A, 3G, 3R, 3S, 4M, 4W, 4Y, 22N, 27V/46T/97A/136V/149E/385P, 27V/46T/385P, 27V/70N/136V/231E/385P, 27V/136V/323I/385P, 27V/149E, 27V/149E/385P, 27V/385P, 34D, 38A, 38H, 38L, 41V, 44E, 46T/70N, 46T/149E/183L/231E/385P, 48V, 70N, 73C/305I, 73I, 73R, 82C, 82E, 82E/94S/101S/194N/199L, 82E/94S/199L, 82F, 82G, 82L, 83G, 83K, 85I, 85W, 87R, 89A, 89T, 89V, 89W, 92A, 94S, 96E, 96N, 96S, 97A/149E/385P, 135G, 135Q, 135S, 135T, 135V, 136V/385P, 140T, 141A, 141F, 141L, 141S, 142A, 142F, 142I, 142L, 144M, 144R, 144W, 146A, 146F, 146S, 146Y, 149E, 149E/231E/385P, 149K, 149R, 151A, 151I, 151L, 174H, 174R, 175G, 175L, 175R, 178R, 178T, 181H, 183L/385P, 189A, 189E, 189W, 194N, 194N/199L, 194T, 195D/231E/385P, 195V, 199L, 199L/213A, 210A, 210V, 212C, 212G, 212R, 212T, 213A/330T, 213H, 216R, 216T, 216W, 218D, 218G, 218I, 218M, 218T, 219C, 219G, 219K, 219R, 226R, 231E/385P, 238S, 247R, 250T, 270V, 274D, 281K, 281R, 292A, 292C, 292L, 292V, 296M, 296R, 300A, 300D, 300T, 308A, 330Y, 338N, 379T, 385A, 385C, 385D, 385P, 385R, and 385T, wherein the amino acid positions of the polypeptide sequence are numbered with reference to SEQ ID NO: 2. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant lipase comprises at least one substitution or substitution set selected from E2H, E2M, E2T, T3A, T3G, T3R, T3S, S4M, S4W, S4Y, G22N, Y27V/R46T/Y97A/Y136V/T149E/F385P, Y27V/R46T/F385P, Y27V/K70N/Y136V/Q231E/F385P, Y27V/Y136V/K323I/F385P, Y27V/T149E, Y27V/T149E/F385P, Y27V/F385P, K34D, F38A, F38H, F38L, N41V, G44E, R46T/K70N, R46T/T149E/F183L/Q231E/F385P, Y48V, K70N, T73C/V305I, T73I, T73R, K82C, K82E, K82E/P94S/D101S/K194N/I199L, K82E/P94S/I199L, K82F, K82G, K82L, E83G, E83K, G85I, G85W, A87R, F89A, F89T, F89V, F89W, T92A, P94S, I96E, I96N, I96S, Y97A/T149E/F385P, Y135G, Y135Q, Y135S, Y135T, Y135V, Y136V/F385P, P140T, E141A, E141F, E141L, E141S, E142A, E142F, E142I, E142L, I144M, I144R, I144W, P146A, P146F, P146S, P146Y, T149E, T149E/Q231E/F385P, T149K, T149R, G151A, G151I, G151L, E174H, E174R, Q175G, Q175L, Q175R, S178R, S178T, K181H, F183L/F385P, S189A, S189E, S189W, K194N, K194N/I199L, K194T, Q195D/Q231E/F385P, Q195V, I199L, I199L/P213A, K210A, K210V, Q212C, Q212G, Q212R, Q212T, P213A/N330T, P213H, S216R, S216T, S216W, H218D, H218G, H218I, H218M, H218T, A219C, A219G, A219K, A219R, T226R, Q231E/F385P, Y238S, E247R, Q250T, R270V, T274D, G281K, G281R, M292A, M292C, M292L, M292V, S296M, S296Q, Q300A, Q300D, Q300T, R308A, N330Y, K338N, N379T, F385A, F385C, F385D, F385P, F385R, and F385T, wherein the amino acid positions of the polypeptide sequence are numbered with reference to SEQ ID NO: 2.

In some embodiments, the recombinant lipase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 94, or a functional fragment thereof, and wherein the recombinant lipase comprises at least one substitution or substitution set at one or more positions selected from 3/4/96/296/300, 3/292/296, 4, 4/11/149/292/296/300, 4/96/149/231/296/300, 4/96/149/292/296/300, 4/96/219/296, 4/96/231/296/300, 4/96/292/296/300, 4/149/174, 4/174/219/292/296, 4/231/296/300, 27, 27/34/82, 27/73/82/218, 27/89, 27/89/178, 27/89/218, 27/218, 34/73/218, 34/82, 34/218, 73/82, 73/82/183, 94/146/175, 96/149/174/292/296, 96/149/231/292/296, 96/149/292/296, 96/174/219/231/292/296, 96/231/296, 146/175/189/281, 149/174/292/296, 149/174/300, 149/219/231/292/296/300, 149/231/292/296, 149/231/292/296/300, 149/296, 149/296/300, 174/231, 174/296, 218, 231, 231/292/296, 231/292/296/300, 231/296, 231/300, 292/296, 292/296/300, 296, and 296/300, wherein the amino acid positions of the polypeptide sequence are numbered with reference to SEQ ID NO: 94. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 94, or a functional fragment thereof, and wherein the recombinant lipase comprises at least one substitution or substitution set selected from 3S/4W/96E/296R/300D, 3S/292L/296R, 4W, 4W/11A/149E/292L/296R/300D, 4W/96E/149E/231E/296R/300D, 4W/96E/149E/292L/296R/300D, 4W/96E/219K/296R, 4W/96E/231E/296R/300D, 4W/96E/292L/296R/300D, 4W/149E/174R, 4W/174H/219K/292L/296R, 4W/231E/296R/300D, 27V, 27V/34D/82E, 27V/73I/82L/218I, 27V/73I/82L/

218M, 27V/89T, 27V/89T/178P, 27V/89T/218I, 27V/218I, 34D/73I/218I, 34D/82C, 34D/218M, 73I/82C, 73I/82L/ 183L, 94S/146F/175G, 96E/149E/174H/292L/296R, 96E/ 149E/231E/292L/296R, 96E/149E/292L/296R, 96E/174H/ 219K/231E/292L/296R, 96E/231E/296R, 146F/175G/ 189A/281K, 149E/174H/292L/296R, 149E/174H/300D, 149E/219K/231E/292L/296R/300D, 149E/231E/292L/ 296R, 149E/231E/292L/296R/300D, 149E/296R, 149E/ 296R/300D, 174H/296R, 174R/231E, 218I, 231E, 231E/ 292L/296R, 231E/292L/296R/300D, 231E/296R, 231E/ 300D, 292L/296R, 292L/296R/300D, 296R, and 296R/ 300D, wherein the amino acid positions of the polypeptide sequence are numbered with reference to SEQ ID NO: 94. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 94, or a functional fragment thereof, and wherein the recombinant lipase comprises at least one substitution or substitution set selected from T3S/S4W/I96E/S296R/Q300D, T3S/M292L/S296R, S4W, S4W/V11A/T149E/M292L/ S296R/Q300D, S4W/I96E/T149E/Q231E/S296R/Q300D, S4W/I96E/T149E/M292L/S296R/Q300D, S4W/I96E/ A219K/S296R, S4W/I96E/Q231E/S296R/Q300D, S4W/ I96E/M292L/S296R/Q300D, S4W/T149E/E174R, S4W/ E174H/A219K/M292L/S296R, S4W/Q231E/S296R/ Q300D, Y27V, Y27V/K34D/K82E, Y27V/T73I/K82L/ H218I, Y27V/T73I/K82L/H218M, Y27V/F89T, Y27V/ F89T/S178P, Y27V/F89T/H218I, Y27V/H218I, K34D/ T73I/H218I, K34D/K82C, K34D/H218M, T73I/K82C, T73I/K82L/F183L, P94S/P146F/Q175G, I96E/T149E/ E174H/M292L/S296R, I96E/T149E/Q231E/M292L/ S296R, I96E/T149E/M292L/S296R, I96E/E174H/A219K/ Q231E/M292L/S296R, I96E/Q231E/S296R, P146F/ Q175G/S189A/G281K, T149E/E174H/M292L/S296R, T149E/E174H/Q300D, T149E/A219K/Q231E/M292L/ S296R/Q300D, T149E/Q231E/M292L/S296R, T149E/ Q231E/M292L/S296R/Q300D, T149E/S296R, T149E/ S296R/Q300D, E174H/S296R, E174R/Q231E, H218I, Q231E, Q231E/M292L/S296R, Q231E/M292L/S296R/ Q300D, Q231E/S296R, Q231E/Q300D, M292L/S296R, M292L/S296R/Q300D, S296R, and S296R/Q300D, wherein the amino acid positions of the polypeptide sequence are numbered with reference to SEQ ID NO: 94.

In some embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 350, or a functional fragment thereof, and wherein the recombinant lipase comprises at least one substitution or substitution set at one or more positions selected from 4, 4/27/189/300, 4/70, 4/102, 4/137, 4/175/189/218, 4/175/189/300, 4/175/ 218/224, 4/175/218/373, 4/185, 4/189/218/373, 4/193, 4/218/300/369/373, 4/228, 4/233, 4/243, 4/271, 4/303, 4/334, 4/336, 4/375, 25, 27/82/174/175/189/218/300/369/ 373, 27/82/174/175/218/300/369, 27/82/174/175/218/300/ 373/382, 27/82/174/218/300/373, 27/189/218/373, 28, 33, 99, 102, 104, 134, 153, 174/175/189, 174/373, 175/189/218/ 300/373, 175/189/373, 175/218, 175/218/382, 189/218/300/ 373, 191, 193, 231, 233, 243, 293, 303, 331, 336, 339, 368, and 373, wherein the amino acid positions of the polypeptide sequence are numbered with reference to SEQ ID NO: 350. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 350, or a functional fragment thereof, and wherein the recombinant lipase comprises at least one substitution or substitution set selected from 4W, 4W/27V/189A/300D, 4W/70H, 4W/102T, 4W/137R, 4W/175G/189A/218M, 4W/175G/189A/300D, 4W/175G/218M/224A, 4W/175G/ 218M/373F, 4W/185L, 4W/189A/218M/373F, 4W/193T, 4W/218M/300D/369N/373F, 4W/228E, 4W/233R, 4W/243R, 4W/271D, 4W/303P, 4W/334T, 4W/336S, 4W/336T, 4W/375A, 25V, 27V/82C/174H/175G/189A/ 218M/300D/369N/373F, 27V/82C/174H/175G/218M/ 300D/369N, 27V/82C/174H/175G/218M/300D/373F/ 382M, 27V/82C/174H/218M/300D/373F, 27V/189A/ 218M/373F, 28N, 33Y, 99D, 102L, 104H, 134R, 153G, 174H/175L/189A, 174H/373F, 175G/189A/218M/300D/ 373F, 175G/218M, 175G/218M/382M, 175L/189A/373F, 189A/218M/300D/373F, 191L, 193L, 231Q, 233G, 233S, 233W, 243R, 293R, 303P, 331R, 336R, 339K, 368A, 368T, and 373F, wherein the amino acid positions of the polypeptide sequence are numbered with reference to SEQ ID NO: 350. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 350, or a functional fragment thereof, and wherein the recombinant lipase comprises at least one substitution or substitution set selected from S4W, S4W/Y27V/S189A/ Q300D, S4W/K70H, S4W/E102T, S4W/S137R, S4W/ Q175G/S189A/H218M, S4W/Q175G/S189A/Q300D, S4W/Q175G/H218M/V224A, S4W/Q175G/H218M/ Y373F, S4W/I185L, S4W/S189A/H218M/Y373F, S4W/ Q193T, S4W/H218M/Q300D/S369N/Y373F, S4W/P228E, S4W/N233R, S4W/L243R, S4W/G271D, S4W/A303P, S4W/D334T, S4W/A336S, S4W/A336T, S4W/N375A, L25V, Y27V/K82C/E174H/Q175G/S189A/H218M/ Q300D/S369N/Y373F, Y27V/K82C/E174H/Q175G/ H218M/Q300D/S369N, Y27V/K82C/E174H/Q175G/ H218M/Q300D/Y373F/H382M, Y27V/K82C/E174H/ H218M/Q300D/Y373F, Y27V/S189A/H218M/Y373F, R28N, L33Y, Q99D, E102L, N104H, E134R, N153G, E174H/Q175L/S189A, E174H/Y373F, Q175G/S189A/ H218M/Q300D/Y373F, Q175G/H218M, Q175G/H218M/ H382M, Q175L/S189A/Y373F, S189A/H218M/Q300D/ Y373F, A191L, Q193L, E231Q, N233G, N233S, N233W, L243R, Q293R, A303P, S331R, A336R, Q339K, F368A, F368T, and Y373F, wherein the amino acid positions of the polypeptide sequence are numbered with reference to SEQ ID NO: 350.

In some embodiments, the recombinant lipase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 442, or a functional fragment thereof, and wherein the recombinant lipase comprises at least one substitution or substitution set at one or more positions selected from 26, 33, 33/174/193/243, 33/174/334, 33/175/218/303, 33/175/ 218/334/339, 33/193, 34, 38, 46, 48, 70/271/293/334, 144, 174, 174/175/193, 174/175/218/339, 174/193/303/375, 174/ 193/375, 174/218/233/271/293/303, 174/218/271/303, 175/ 193/218/233/243/375, 175/193/218/243, 175/218/375, 181, 189, 193, 193/218/243, 193/271/303/334, 193/293/303, 194, 195, 199, 210, 218, 218/243, 218/243/303/334, 218/303, 225, 238, 274, 281, and 330, wherein the amino acid positions of the polypeptide sequence are numbered with reference to SEQ ID NO: 442. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 442, or a functional fragment thereof, and wherein the recombinant lipase comprises at least one substitution or substitution set selected from G26A, G26R, G26S, L33Y, L33Y/E174H/Q193L/L243R, L33Y/E174H/D334T, L33Y/L175G/H218M/A303P, L33Y/L175G/H218M/D334T/Q339K, L33Y/Q193L, K34L, F38A, F38G, R46P, Y48L, K70H/G271D/Q293R/D334T, I144L, E174H, E174H/L175G/Q193L, E174H/L175G/H218M/Q339K, E174H/Q193L/A303P/N375A, E174H/Q193L/N375A, E174H/H218M/N233R/G271D/Q293R/A303P, E174H/H218M/G271D/A303P, E174R, L175G/Q193L/H218M/N233R/L243R/N375A, L175G/Q193L/H218M/L243R, L175G/H218M/N375A, K181Q, A189H, Q193L, Q193L/H218M/L243R, Q193L/G271D/A303P/D334T, Q193L/Q293R/A303P, K194T, Q195I, Q195L, Q195Y, I199H, K210V, H218C, H218D, H218M, H218M/L243R, H218M/L243R/A303P/D334T, H218M/A303P, H218P, M225L, Y238W, T274D, G281K, G281P, N330F, and N330H, wherein the amino acid positions of the polypeptide sequence are numbered with reference to SEQ ID NO: 442.

In some embodiments, the recombinant lipase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 540, or a functional fragment thereof, and wherein the recombinant lipase comprises at least one substitution or substitution set at one or more positions selected from 34/38/174/193/195/243/281/303/330, 34/38/174/225/303, 34/38/174/303/345, 34/174, 34/174/193/195/243/281, 34/174/193/195/303/330, 34/193/195/225/243, 34/193/243/303/330, 34/281/330, 38, 38/174/193/195/243/330, 38/174/193/225/274/283/303/330, 38/174/193/303, 38/174/195/281/330, 38/174/225/243/281/330, 38/174/281, 38/174/281/303, 38/174/281/303/345, 38/193/195/225/303/345, 38/195/243/303, 38/195/281/303/330, 38/195/281/330, 38/195/303, 49, 49/51/98/252/311, 49/51/123/252/344, 49/98/120/252/344, 49/120/252/344, 49/123/252/344, 49/123/264/344, 49/123/311, 49/252/344, 49/311/344, 49/344, 51, 51/252/344, 51/344, 98, 98/344, 123/252/344, 129, 160, 161, 174/193/195/225, 174/193/303/330, 174/195/225/281/303/330/345, 174/195/243/281/345, 174/195/281/303, 174/225/243/281/303/345, 174/281/330, 174/303, 195/225/303/330, 252, 268, and 344, wherein the amino acid positions of the polypeptide sequence are numbered with reference to SEQ ID NO: 540. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 540, or a functional fragment thereof, and wherein the recombinant lipase comprises at least one substitution or substitution set selected from 34L/38A/174G/193L/195L/243R/281P/303P/330F, 34L/38A/174R/303P/345I, 34L/38G/174R/225L/303P, 34L/174G, 34L/174G/193L/195L/243R/281P, 34L/174H/193L/195I/303P/330F, 34L/193L/195I/225L/243R, 34L/193L/243R/303P/330F, 34L/281P/330H, 38A/174H/193L/225L/274D/283I/303P/330F, 38A/174R/281K/303P/345I, 38A/193L/195L/225L/303P/345I, 38A/195I/303P, 38A/195Y/281K/303P/330F, 38G, 38G/174G/193L/303P, 38G/174G/281K/303P, 38G/174H/195L/281P/330F, 38G/174H/225L/243R/281K/330H, 38G/174H/281K, 38G/174R/193L/195L/243R/330H, 38G/195I/281P/330F, 38G/195Y/243R/303P, 49S, 49T, 49T/51A/98P/252V/311W, 49T/51A/123Q/252V/344H, 49T/98P/120T/252V/344H, 49T/120T/252V/344H, 49T/123Q/252V/344H, 49T/123Q/264S/344H, 49T/123Q/311W, 49T/252V/344H, 49T/311W/344H, 49T/344H, 51A/252V/344H, 51A/344H, 51V, 98P/344H, 98R, 123Q/252V/344H, 129F, 160T, 161I, 174G/195I/225L/281K/303P/330F/345I, 174G/225L/243R/281P/303P/345I, 174H/195I/243R/281K/345I, 174H/281P/330H, 174R/193L/195I/225L, 174R/193L/303P/330H, 174R/195I/281K/303P, 174R/303P, 195Y/225L/303P/330H, 252V, 268T, 344I, 344V, and 344W, wherein the amino acid positions of the polypeptide sequence are numbered with reference to SEQ ID NO: 540. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 540, or a functional fragment thereof, and wherein the recombinant lipase comprises at least one substitution or substitution set selected from K34L/F38A/E174G/Q193L/Q195L/L243R/G281P/A303P/N330F, K34L/F38A/E174R/A303P/F345I, K34L/F38G/E174R/M225L/A303P, K34L/E174G, K34L/E174G/Q193L/Q195L/L243R/G281P, K34L/E174H/Q193L/Q195I/A303P/N330F, K34L/Q193L/Q195I/M225L/L243R, K34L/Q193L/L243R/A303P/N330F, K34L/G281P/N330H, F38A/E174H/Q193L/M225L/T274D/M283I/A303P/N330F, F38A/E174R/G281K/A303P/F345I, F38A/Q193L/Q195L/M225L/A303P/F345I, F38A/Q195I/A303P, F38A/Q195Y/G281K/A303P/N330F, F38G, F38G/E174G/Q193L/A303P, F38G/E174G/G281K/A303P, F38G/E174H/Q195L/G281P/N330F, F38G/E174H/M225L/L243R/G281K/N330H, F38G/E174H/G281K, F38G/E174R/Q193L/Q195L/L243R/N330H, F38G/Q195I/G281P/N330F, F38G/Q195Y/L243R/A303P, V49S, V49T, V49T/T51A/G98P/M252V/L311W, V49T/T51A/E123Q/M252V/S344H, V49T/G98P/M120T/M252V/S344H, V49T/M120T/M252V/S344H, V49T/E123Q/M252V/S344H, V49T/E123Q/T264S/S344H, V49T/E123Q/L311W, V49T/M252V/S344H, V49T/L311W/S344H, V49T/S344H, T51A/M252V/S344H, T51A/S344H, T51V, G98P/S344H, G98R, E123Q/M252V/S344H, S129F, S160T, L161I, E174G/Q195I/M225L/G281K/A303P/N330F/F345I, E174G/M225L/L243R/G281P/A303P/F345I, E174H/Q195I/L243R/G281K/F345I, E174H/G281P/N330H, E174R/Q193L/Q195I/M225L, E174R/Q193L/A303P/N330H, E174R/Q195I/G281K/A303P, E174R/A303P, Q195Y/M225L/A303P/N330H, M252V, S268T, S344I, S344V, and S344W, wherein the amino acid positions of the polypeptide sequence are numbered with reference to SEQ ID NO: 540.

In some embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 646, or a functional fragment thereof, and wherein the recombinant lipase comprises at least one substitution or substitution set at one or more positions selected from 11/16/67/168/180/287, 11/16/237/241/287, 11/67/168/287, 16/67/154/168/237/241/287, 16/67/237/287/291, 16/168/177, 24, 24/278, 34/49/161/193/243/344, 34/49/161/193/344, 34/49/161/243/344, 34/49/161/252/268/344, 34/49/193/243/252/344, 34/49/193/344, 34/49/243/252, 34/49/252/268/344, 34/161/193/243/252/268, 34/161/193/243/268/344, 34/161/193/243/344, 34/161/193/252/268/344, 34/161/193/252/344, 34/161/193/268/344, 34/161/243/281/344, 34/161/344, 34/193/243/252/344, 34/193/252/268/344, 34/193/268/281, 34/252/268/281/344, 34/252/344, 49/161/193/243/252/344, 49/161/193/252/281/344, 49/161/243/252/344, 49/193/197/243/252/281/344, 49/193/243/252/344, 49/193/243/344, 49/243/344, 67/154/237/287, 67/168/237, 67/168/237/287, 67/177/237, 154/237/286/287, 154/286/287, 161/193/252/344, 161/193/344, 161/344, 168/237, 186/187/278, 193/243/281/344, 193/252/268/344, 193/252/281/344, 237, 237/287/

291, and 281/344, wherein the amino acid positions of the polypeptide sequence are numbered with reference to SEQ ID NO: 646. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 646, or a functional fragment thereof, and wherein the recombinant lipase comprises at least one substitution or substitution set selected from 11I/16F/67A/168T/180V/287L, 11I/16F/237Q/241S/287L, 11I/67A/168T/287L, 16F/67A/154Y/168T/237Q/241S/287L, 16F/67A/237Q/287L/291A, 16F/168T/177L, 24M, 24M/278L, 34K/49T/161I/193L/243R/344H, 34K/49T/161I/193L/243R/344V, 34K/49T/161I/193L/344W, 34K/49T/161I/243R/344H, 34K/49T/161I/252V/268T/344V, 34K/49T/193L/243R/252V/344W, 34K/49T/193L/344H, 34K/49T/193L/344W, 34K/49T/243R/252V, 34K/49T/252V/268T/344V, 34K/161I/193L/243R/252V/268T, 34K/161I/193L/243R/268T/344V, 34K/161I/193L/243R/344W, 34K/161I/193L/252V/268T/344H, 34K/161I/193L/252V/268T/344V, 34K/161I/193L/252V/344H, 34K/161I/193L/252V/344V, 34K/161I/193L/252V/344W, 34K/161I/193L/268T/344H, 34K/161I/243R/281P/344V, 34K/161I/344V, 34K/161I/344W, 34K/193L/243R/252V/344W, 34K/193L/252V/268T/344H, 34K/193L/268T/281P, 34K/252V/268T/281P/344V, 34K/252V/344V, 49T/161I/193L/243R/252V/344W, 49T/161I/193L/252V/281P/344H, 49T/161I/243R/252V/344V, 49T/193L/197G/243R/252V/281P/344H, 49T/193L/243R/252V/344V, 49T/193L/243R/344W, 49T/243R/344V, 67A/154Y/237Q/287L, 67A/168T/237Q, 67A/168T/237Q/287L, 67A/177L/237Q, 154Y/237Q/286V/287L, 154Y/286V/287L, 161I/193L/252V/344V, 161I/193L/344W, 161I/344W, 168T/237Q, 186T/187A/278L, 193L/243R/281P/344W, 193L/252V/268T/344V, 193L/252V/281P/344H, 237Q, 237Q/287L/291A, and 281P/344W, wherein the amino acid positions of the polypeptide sequence are numbered with reference to SEQ ID NO: 646. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 646, or a functional fragment thereof, and wherein the recombinant lipase comprises at least one substitution or substitution set selected from V11I/L16F/Y67A/S168T/I180V/F287L, V11I/L16F/A237Q/T241S/F287L, V11I/Y67A/S168T/F287L, L16F/Y67A/W154Y/S168T/A237Q/T241S/F287L, L16F/Y67A/A237Q/F287L/S291A, L16F/S168T/V177L, F24M, F24M/Y278L, L34K/V49T/L161I/Q193L/L243R/S344H, L34K/V49T/L161I/Q193L/L243R/S344V, L34K/V49T/L161I/Q193L/S344W, L34K/V49T/L161I/L243R/S344H, L34K/V49T/L161I/M252V/S268T/S344V, L34K/V49T/Q193L/L243R/M252V/S344W, L34K/V49T/Q193L/S344H, L34K/V49T/Q193L/S344W, L34K/V49T/L243R/M252V, L34K/V49T/M252V/S268T/S344V, L34K/L161I/Q193L/L243R/M252V/S268T, L34K/L161I/Q193L/L243R/S268T/S344V, L34K/L161I/Q193L/L243R/S344W, L34K/L161I/Q193L/M252V/S268T/S344H, L34K/L161I/Q193L/M252V/S268T/S344V, L34K/L161I/Q193L/M252V/S344H, L34K/L161I/Q193L/M252V/S344V, L34K/L161I/Q193L/M252V/S344W, L34K/L161I/Q193L/S268T/S344H, L34K/L161I/L243R/G281P/S344V, L34K/L161I/S344V, L34K/L161I/S344W, L34K/Q193L/L243R/M252V/S344W, L34K/Q193L/M252V/S268T/S344H, L34K/Q193L/S268T/G281P, L34K/M252V/S268T/G281P/S344V, L34K/M252V/S344V, V49T/L161I/Q193L/L243R/M252V/S344W, V49T/L161I/Q193L/M252V/G281P/S344H, V49T/L161I/L243R/M252V/S344W, V49T/Q193L/ S197G/L243R/M252V/G281P/S344H, V49T/Q193L/L243R/M252V/S344V, V49T/Q193L/L243R/S344W, V49T/L243R/S344V, Y67A/W154Y/A237Q/F287L, Y67A/S168T/A237Q, Y67A/S168T/A237Q/F287L, Y67A/V177L/A237Q, W154Y/A237Q/L286V/F287L, W154Y/L286V/F287L, L161I/Q193L/M252V/S344V, L161I/Q193L/S344W, L161I/S344W, S168T/A237Q, H186T/L187A/Y278L, Q193L/L243R/G281P/S344W, Q193L/M252V/S268T/S344V, Q193L/M252V/G281P/S344H, A237Q, A237Q/F287L/S291A, and G281P/S344W, wherein the amino acid positions of the polypeptide sequence are numbered with reference to SEQ ID NO: 646.

In some embodiments, the recombinant lipase A comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 758, or a functional fragment thereof, and wherein the recombinant lipase comprises at least one substitution or substitution set at one or more positions selected from 24/168/252/281, 24/237/287/344, 24/252, 24/252/287, 24/344, 213/252/278/344, 252/278/344, 252/287/344, and 281, wherein the amino acid positions of the polypeptide sequence are numbered with reference to SEQ ID NO: 758. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 758, or a functional fragment thereof, and wherein the recombinant lipase comprises at least one substitution or substitution set selected from 24M/168T/252V/281P, 24M/237Q/287L/344S, 24M/252V, 24M/252V/287L, 24M/344W, 213S/252V/278L/344S, 252V/278L/344W, 252V/287L/344S, and 281P, wherein the amino acid positions of the polypeptide sequence are numbered with reference to SEQ ID NO: 758. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 758, or a functional fragment thereof, and wherein the recombinant lipase comprises at least one substitution or substitution set selected from F24M/S168T/M252V/G281P, F24M/A237Q/F287L/H344S, F24M/M252V, F24M/M252V/F287L, F24M/H344W, P213S/M252V/Y278L/H344S, M252V/Y278L/H344W, M252V/F287L/H344S, and G281P, wherein the amino acid positions of the polypeptide sequence are numbered with reference to SEQ ID NO: 758.

In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 868, or a functional fragment thereof, and wherein the recombinant lipase comprises at least one substitution or substitution set at one or more positions selected from 24, 24/38/49/70/149/161/174/175/189/193/225/231/243/252/271/287/292/293/296/303/334/344/373/385, 38, 49, 70, 149, 161, 174, 175, 189, 193, 225, 231, 243, 252, 271, 287, 292, 293, 296, 303, 334, 344, 373, and 385, wherein the amino acid positions of the polypeptide sequence are numbered with reference to SEQ ID NO: 868. In some further embodiments, the recombinant lipase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 868, or a functional fragment thereof, and wherein the recombinant lipase comprises at least one substitution or substitution set selected from 24A, 24C, 24D, 24E, 24F, 24F/38F/49V/70K/149T/

161L/174E/175Q/189S/193Q/225M/231Q/243L/252M/
271G/287F/292M/293Q/296S/303A/334D/344S/373Y/
385F, 24G, 24H, 24I, 24K, 24L, 24N, 24P, 24Q, 24R, 24S,
24T, 24V, 24W, 24Y, 38A, 38C, 38D, 38E, 38F, 38H, 38I,
38K, 38L, 38M, 38N, 38P, 38Q, 38R, 38S, 38T, 38V, 38W,
38Y, 49A, 49C, 49D, 49E, 49F, 49G, 49H, 49I, 49K, 49L,
49M, 49N, 49P, 49Q, 49R, 49S, 49V, 49W, 49Y, 70A, 70C,
70D, 70E, 70F, 70G, 70I, 70K, 70L, 70M, 70N, 70P, 70Q,
70R, 70S, 70T, 70V, 70W, 70Y, 149A, 149C, 149D, 149F,
149G, 149H, 149I, 149K, 149L, 149M, 149N, 149P, 149Q,
149R, 149S, 149T, 149V, 149W, 149Y, 161A, 161C, 161D,
161E, 161F, 161G, 161H, 161K, 161L, 161M, 161N, 161P,
161Q, 161R, 161S, 161T, 161V, 161W, 161Y, 174A, 174C,
174D, 174E, 174F, 174G, 174H, 174I, 174K, 174L, 174M,
174N, 174P, 174Q, 174S, 174T, 174V, 174W, 174Y, 175A,
175C, 175D, 175E, 175F, 175G, 175H, 175I, 175K, 175M,
175N, 175P, 175Q, 175R, 175S, 175T, 175V, 175W, 175Y,
189C, 189D, 189E, 189F, 189G, 189H, 189I, 189K, 189L,
189M, 189N, 189P, 189Q, 189R, 189S, 189T, 189V, 189W,
189Y, 193A, 193C, 193D, 193E, 193F, 193G, 193H, 193I,
193K, 193M, 193N, 193P, 193Q, 193R, 193S, 193T, 193V,
193W, 193Y, 225A, 225C, 225D, 225E, 225F, 225G, 225H,
225I, 225K, 225M, 225N, 225P, 225Q, 225R, 225S, 225T,
225V, 225W, 225Y, 231A, 231C, 231D, 231F, 231G, 231H,
231I, 231K, 231L, 231M, 231N, 231P, 231Q, 231R, 231S,
231T, 231V, 231W, 231Y, 243A, 243C, 243D, 243E, 243F,
243G, 243H, 243I, 243K, 243L, 243M, 243N, 243P, 243Q,
243S, 243T, 243V, 243W, 243Y, 252A, 252C, 252D, 252E,
252F, 252G, 252H, 252I, 252K, 252L, 252M, 252N, 252P,
252Q, 252R, 252S, 252T, 252W, 252Y, 271A, 271C, 271E,
271F, 271G, 271H, 271I, 271K, 271L, 271M, 271N, 271P,
271Q, 271R, 271S, 271T, 271V, 271W, 271Y, 287A, 287C,
287D, 287E, 287F, 287G, 287H, 287I, 287K, 287M, 287N,
287P, 287Q, 287R, 287S, 287T, 287V, 287W, 287Y, 292A,
292C, 292D, 292E, 292F, 292G, 292H, 292I, 292K, 292M,
292N, 292P, 292Q, 292R, 292S, 292T, 292V, 292W, 292Y,
293A, 293C, 293D, 293E, 293F, 293G, 293H, 293I, 293K,
293L, 293M, 293N, 293P, 293Q, 293S, 293T, 293V, 293W,
293Y, 296A, 296C, 296D, 296E, 296F, 296G, 296H, 296I,
296K, 296L, 296M, 296N, 296P, 296Q, 296S, 296T, 296V,
296W, 296Y, 303A, 303C, 303D, 303E, 303F, 303G, 303H,
303I, 303K, 303L, 303M, 303N, 303Q, 303R, 303S, 303T,
303V, 303W, 303Y, 334A, 334C, 334D, 334E, 334F, 334G,
334H, 334I, 334K, 334L, 334M, 334N, 334P, 334Q, 334R,
334S, 334V, 334W, 334Y, 344A, 344C, 344D, 344E, 344F,
344G, 344I, 344K, 344L, 344M, 344N, 344P, 344Q, 344R,
344S, 344T, 344V, 344W, 344Y, 373A, 373C, 373D, 373E,
373G, 373H, 373I, 373K, 373L, 373M, 373N, 373P, 373Q,
373R, 373S, 373T, 373V, 373W, 373Y, 385A, 385C, 385D,
385E, 385F, 385G, 385H, 385I, 385K, 385L, 385M, 385N,
385Q, 385R, 385S, 385T, 385V, 385W, and 385Y, wherein
the amino acid positions of the polypeptide sequence are
numbered with reference to SEQ ID NO: 868. In some
further embodiments, the recombinant lipase comprises a
polypeptide sequence having at least 85%, 86%, 87%, 88%,
89%, 90%, 91%, 92%, 93%, 94%, 95%, 96%, 97%, 98%,
99%, or more sequence identity to SEQ ID NO: 868, or a
functional fragment thereof, and wherein the recombinant
lipase comprises at least one substitution or substitution set
selected from M24A, M24C, M24D, M24E, M24F, M24F/
G38F/T49V/H70K/E149T/I161L/R174E/L175Q/A189S/
L193Q/L225M/E231Q/R243L/V252M/D271G/L287F/
L292M/R293Q/R296S/P303A/T334D/H344S/F373Y/
P385F, M24G, M24H, M24I, M24K, M24L, M24N, M24P,
M24Q, M24R, M24S, M24T, M24V, M24W, M24Y, G38A,
G38C, G38D, G38E, G38F, G38H, G38I, G38K, G38L,
G38M, G38N, G38P, G38Q, G38R, G38S, G38T, G38V,
G38W, G38Y, T49A, T49C, T49D, T49E, T49F, T49G,
T49H, T49I, T49K, T49L, T49M, T49N, T49P, T49Q,
T49R, T49S, T49V, T49W, T49Y, H70A, H70C, H70D,
H70E, H70F, H70G, H70I, H70K, H70L, H70M, H70N,
H70P, H70Q, H70R, H70S, H70T, H70V, H70W, H70Y,
E149A, E149C, E149D, E149F, E149G, E149H, E149I,
E149K, E149L, E149M, E149N, E149P, E149Q, E149R,
E149S, E149T, E149V, E149W, E149Y, I161A, I161C,
I161D, I161E, I161F, I161G, I161H, I161K, I161L, I161M,
I161N, I161P, I161Q, I161R, I161S, I161T, I161V, I161W,
I161Y, R174A, R174C, R174D, R174E, R174F, R174G,
R174H, R174I, R174K, R174L, R174M, R174N, R174P,
R174Q, R174S, R174T, R174V, R174W, R174Y, L175A,
L175C, L175D, L175E, L175F, L175G, L175H, L175I,
L175K, L175M, L175N, L175P, L175Q, L175R, L175S,
L175T, L175V, L175W, L175Y, A189C, A189D, A189E,
A189F, A189G, A189H, A189I, A189K, A189L, A189M,
A189N, A189P, A189Q, A189R, A189S, A189T, A189V,
A189W, A189Y, L193A, L193C, L193D, L193E, L193F,
L193G, L193H, L193I, L193K, L193M, L193N, L193P,
L193Q, L193R, L193S, L193T, L193V, L193W, L193Y,
L225A, L225C, L225D, L225E, L225F, L225G, L225H,
L225I, L225K, L225M, L225N, L225P, L225Q, L225R,
L225S, L225T, L225V, L225W, L225Y, E231A, E231C,
E231D, E231F, E231G, E231H, E231I, E231K, E231L,
E231M, E231N, E231P, E231Q, E231R, E231S, E231T,
E231V, E231W, E231Y, R243A, R243C, R243D, R243E,
R243F, R243G, R243H, R243I, R243K, R243L, R243M,
R243N, R243P, R243Q, R243S, R243T, R243V, R243W,
R243Y, V252A, V252C, V252D, V252E, V252F, V252G,
V252H, V252I, V252K, V252L, V252M, V252N, V252P,
V252Q, V252R, V252S, V252T, V252W, V252Y, D271A,
D271C, D271E, D271F, D271G, D271H, D271I, D271K,
D271L, D271M, D271N, D271P, D271Q, D271R, D271S,
D271T, D271V, D271W, D271Y, L287A, L287C, L287D,
L287E, L287F, L287G, L287H, L287I, L287K, L287M,
L287N, L287P, L287Q, L287R, L287S, L287T, L287V,
L287W, L287Y, L292A, L292C, L292D, L292E, L292F,
L292G, L292H, L292I, L292K, L292M, L292N, L292P,
L292Q, L292R, L292S, L292T, L292V, L292W, L292Y,
R293A, R293C, R293D, R293E, R293F, R293G, R293H,
R293I, R293K, R293L, R293M, R293N, R293P, R293Q,
R293S, R293T, R293V, R293W, R293Y, R296A, R296C,
R296D, R296E, R296F, R296G, R296H, R296I, R296K,
R296L, R296M, R296N, R296P, R296Q, R296S, R296T,
R296V, R296W, R296Y, P303A, P303C, P303D, P303E,
P303F, P303G, P303H, P303I, P303K, P303L, P303M,
P303N, P303Q, P303R, P303S, P303T, P303V, P303W,
P303Y, T334A, T334C, T334D, T334E, T334F, T334G,
T334H, T334I, T334K, T334L, T334M, T334N, T334P,
T334Q, T334R, T334S, T334V, T334W, T334Y, H344A,
H344C, H344D, H344E, H344F, H344G, H344I, H344K,
H344L, H344M, H344N, H344P, H344Q, H344R, H344S,
H344T, H344V, H344W, H344Y, F373A, F373C, F373D,
F373E, F373G, F373H, F373I, F373K, F373L, F373M,
F373N, F373P, F373Q, F373R, F373S, F373T, F373V,
F373W, F373Y, P385A, P385C, P385D, P385E, P385F,
P385G, P385H, P385I, P385K, P385L, P385M, P385N,
P385Q, P385R, P385S, P385T, P385V, P385W, and P385Y,
wherein the amino acid positions of the polypeptide
sequence are numbered with reference to SEQ ID NO: 868.

In some embodiments, the recombinant lipase comprises
a polypeptide sequence having at least 70%, 75%, 80%,
85%, 86%, 87%, 88%, 89%, 90%, 91%, 92%, 93%, 94%,
95%, 96%, 97%, 98%, 99%, or more sequence identity to
SEQ ID NO: 2, 94, 350, 442, 540, 646, 758, and/or 868, or
a functional fragment thereof, and wherein the recombinant lipase, wherein the amino acid positions of the polypeptide sequence are numbered with reference to SEQ ID NO: 2, 94, 350, 442, 540, 646, 758, and/or 868.

In some embodiments, the recombinant lipase polypeptide sequence has at least 85%, 86%, 87%, 88%, 89%, 90%, 91%, 92%, 93%, 94%, 95%, 96%, 97%, 98%, 99% or more sequence identity to the even-numbered sequences of SEQ ID NOS: 14-1796.

In some embodiments, the engineered lipase polypeptide comprises a functional fragment of an engineered lipase polypeptide encompassed by the invention. Functional fragments have at least 80%, 81%, 82%, 83%, 84%, 85%, 86%, 87%, 88%, 89%, 90%, 91%, 92%, 93%, 94%, 95%, 96%, 97%, 98%, or 99% of the activity of the engineered lipase polypeptide from which is was derived (i.e., the parent engineered lipase). In some embodiments, a functional fragment comprises at least 80%, 81%, 82%, 83%, 84%, 85%, 86%, 87%, 88%, 89%, 90%, 91%, 92%, 93%, 94%, 95%, 96%, 97%, 98% and even 99% of the parent sequence of the engineered lipase. In some embodiments the functional fragment is truncated by less than 5, less than 10, less than 15, less than 10, less than 25, less than 30, less than 35, less than 40, less than 45, and less than 50 amino acids.

Polynucleotides Encoding Engineered Lipase Polypeptides, Expression Vectors and Host Cells:

The present invention provides polynucleotides encoding the engineered lipase polypeptides described herein. In some embodiments, the polynucleotides are operatively linked to one or more heterologous regulatory sequences that control gene expression to create a recombinant polynucleotide capable of expressing the polypeptide. Expression constructs containing a heterologous polynucleotide encoding the engineered lipase polypeptides can be introduced into appropriate host cells to express the corresponding lipase polypeptide.

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode the engineered lipase polypeptide. Thus, having knowledge of a particular amino acid sequence, those skilled in the art could make any number of different nucleic acids by simply modifying the sequence of one or more codons in a way which does not change the amino acid sequence of the protein. In this regard, the present invention specifically contemplates each and every possible variation of polynucleotides that could be made encoding the polypeptides described herein by selecting combinations based on the possible codon choices, and all such variations are to be considered specifically disclosed for any polypeptide described herein, including the variants provided in Tables 4-1, 4-2, 4-3, 4-4, 4-5, 4-6, 4-7, and 5-1.

In various embodiments, the codons are preferably selected to fit the host cell in which the protein is being produced. For example, preferred codons used in bacteria are used for expression in bacteria, while preferred codons used in fungi are used for expression in fungi. Consequently, codon optimized polynucleotides encoding the engineered lipase polypeptides contain preferred codons at about 40%, 50%, 60%, 70%, 80%, or greater than 90% of codon positions of the full length coding region.

In some embodiments, the present invention provides a recombinant polynucleotide sequence having at least about 85%, about 86%, about 87%, about 88%, about 89%, about 90%, about 91%, about 92%, about 93%, about 94%, about 95%, about 96%, about 97%, about 98%, about 99%, or more sequence identity to SEQ ID NO: 1, 93, 349, 441, 539, 645, 757, and/or 867. In some embodiments, the present invention provides a recombinant polynucleotide sequence having at least 85%, 86%, 87%, 88%, 89%, 90%, 91%, 92%, 93%, 94%, 95%, 96%, 97%, 98%, 99%, or more sequence identity to SEQ ID NO: 1, 93, 349, 441, 539, 645, 757, and/or 867. In some embodiments, the recombinant polynucleotide sequence has at least 85%, 86%, 87%, 88%, 89%, 90%, 91%, 92%, 93%, 94%, 95%, 96%, 97%, 98%, 99% or more sequence identity to the odd-numbered sequences of SEQ ID NOS: 13-1795.

In some embodiments, the polynucleotide encodes a recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant lipase comprises at least one substitution or substitution set at one or more positions selected from 2, 3, 4, 22, 27/46/97/136/149/385, 27/46/385, 27/70/136/231/385, 27/136/323/385, 27/149, 27/149/385, 27/385, 34, 38, 41, 44, 46/70, 46/149/183/231/385, 48, 70, 73, 73/305, 82, 82/94/101/194/199, 82/94/199, 83, 85, 87, 89, 92, 94, 96, 97/149/385, 135, 136/385, 140, 141, 142, 144, 146, 149, 149/231/385, 151, 174, 175, 178, 181, 183/385, 189, 194, 194/199, 195, 195/231/385, 199, 199/213, 210, 212, 213, 213/330, 216, 218, 219, 226, 231/385, 238, 247, 250, 270, 274, 281, 292, 296, 300, 308, 330, 338, 379, and 385, wherein the amino acid positions of the polypeptide sequence are numbered with reference to SEQ ID NO: 2. In some embodiments, the polynucleotide encodes a recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant lipase comprises at least one substitution or substitution set selected from 2H, 2M, 2T, 3A, 3G, 3R, 3S, 4M, 4W, 4Y, 22N, 27V/46T/97A/136V/149E/385P, 27V/46T/385P, 27V/70N/136V/231E/385P, 27V/136V/323I/385P, 27V/149E, 27V/149E/385P, 27V/385P, 34D, 38A, 38H, 38L, 41V, 44E, 46T/70N, 46T/149E/183L/231E/385P, 48V, 70N, 73C/305I, 73I, 73R, 82C, 82E, 82E/94S/101S/194N/199L, 82E/94S/199L, 82F, 82G, 82L, 83G, 83K, 85I, 85W, 87R, 89A, 89T, 89V, 89W, 92A, 94S, 96E, 96N, 96S, 97A/149E/385P, 135G, 135Q, 135S, 135T, 135V, 136V/385P, 140T, 141A, 141F, 141L, 141S, 142A, 142F, 142I, 142L, 144M, 144R, 144W, 146A, 146F, 146S, 146Y, 149E, 149E/231E/385P, 149K, 149R, 151A, 151I, 151L, 174H, 174R, 175G, 175L, 175R, 178R, 178T, 181H, 183L/385P, 189A, 189E, 189W, 194N, 194N/199L, 194T, 195D/231E/385P, 195V, 199L, 199L/213A, 210A, 210V, 212C, 212G, 212R, 212T, 213A/330T, 213H, 216R, 216T, 216W, 218D, 218G, 218I, 218M, 218T, 219C, 219G, 219K, 219R, 226R, 231E/385P, 238S, 247R, 250T, 270V, 274D, 281K, 281R, 292A, 292C, 292L, 292V, 296M, 296R, 300A, 300D, 300T, 308A, 330Y, 338N, 379T, 385A, 385C, 385D, 385P, 385R, and 385T, wherein the amino acid positions of the polypeptide sequence are numbered with reference to SEQ ID NO: 2. In some embodiments, the polynucleotide encodes a recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant lipase comprises at least one substitution or substitution set selected from E2H, E2M, E2T, T3A, T3G, T3R, T3S, S4M, S4W, S4Y, G22N, Y27V/R46T/Y97A/Y136V/T149E/ F385P, Y27V/R46T/F385P, Y27V/K70N/Y136V/Q231E/ F385P, Y27V/Y136V/K323I/F385P, Y27V/T149E, Y27V/ T149E/F385P, Y27V/F385P, K34D, F38A, F38H, F38L, N41V, G44E, R46T/K70N, R46T/T149E/F183L/Q231E/ F385P, Y48V, K70N, T73C/V305I, T73I, T73R, K82C, K82E, K82E/P94S/D101S/K194N/I199L, K82E/P94S/ I199L, K82F, K82G, K82L, E83G, E83K, G85I, G85W, A87R, F89A, F89T, F89V, F89W, T92A, P94S, I96E, I96N, I96S, Y97A/T149E/F385P, Y135G, Y135Q, Y135S, Y135T, Y135V, Y136V/F385P, P140T, E141A, E141F, E141L, E141S, E142A, E142F, E142I, E142L, I144M, I144R, I144W, P146A, P146F, P146S, P146Y, T149E, T149E/ Q231E/F385P, T149K, T149R, G151A, G151I, G151L, E174H, E174R, Q175G, Q175L, Q175R, S178R, S178T, K181H, F183L/F385P, S189A, S189E, S189W, K194N, K194N/I199L, K194T, Q195D/Q231E/F385P, Q195V, I199L, I199L/P213A, K210A, K210V, Q212C, Q212G, Q212R, Q212T, P213A/N330T, P213H, S216R, S216T, S216W, H218D, H218G, H218I, H218M, H218T, A219C, A219G, A219K, A219R, T226R, Q231E/F385P, Y238S, E247R, Q250T, R270V, T274D, G281K, G281R, M292A, M292C, M292L, M292V, S296M, S296R, Q300A, Q300D, Q300T, R308A, N330Y, K338N, N379T, F385A, F385C, F385D, F385P, F385P, F385R, and F385T, wherein the amino acid positions of the polypeptide sequence are numbered with reference to SEQ ID NO: 2.

In some embodiments, the polynucleotide encodes a recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 94, or a functional fragment thereof, and wherein the recombinant lipase comprises at least one substitution or substitution set at one or more positions selected from 3/4/96/296/300, 3/292/296, 4, 4/11/149/292/ 296/300, 4/96/149/231/296/300, 4/96/149/292/296/300, 4/96/219/296, 4/96/231/296/300, 4/96/292/296/300, 4/149/ 174, 4/174/219/292/296, 4/231/296/300, 27, 27/34/82, 27/73/82/218, 27/89, 27/89/178, 27/89/218, 27/218, 34/73/ 218, 34/82, 34/218, 73/82, 73/82/183, 94/146/175, 96/149/ 174/292/296, 96/149/231/292/296, 96/149/292/296, 96/174/ 219/231/292/296, 96/231/296, 146/175/189/281, 149/174/ 292/296, 149/174/300, 149/219/231/292/296/300, 149/231/ 292/296, 149/231/292/296/300, 149/296, 149/296/300, 174/ 231, 174/296, 218, 231, 231/292/296, 231/292/296/300, 231/296, 231/300, 292/296, 292/296/300, 296, and 296/300, wherein the amino acid positions of the polypeptide sequence are numbered with reference to SEQ ID NO: 94. In some embodiments, the polynucleotide encodes a recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 94, or a functional fragment thereof, and wherein the recombinant lipase comprises at least one substitution or substitution set selected from 3S/4W/96E/ 296R/300D, 3S/292L/296R, 4W, 4W/11A/149E/292L/ 296R/300D, 4W/96E/149E/231E/296R/300D, 4W/96E/ 149E/292L/296R/300D, 4W/96E/219K/296R, 4W/96E/ 231E/296R/300D, 4W/96E/292L/296R/300D, 4W/149E/ 174R, 4W/174H/219K/292L/296R, 4W/231E/296R/300D, 27V, 27V/34D/82E, 27V/73I/82L/218I, 27V/73I/82L/ 218M, 27V/89T, 27V/89T/178P, 27V/89T/218I, 27V/218I, 34D/73I/218I, 34D/82C, 34D/218M, 73I/82C, 73I/82L/ 183L, 94S/146F/175G, 96E/149E/174H/292L/296R, 96E/ 149E/231E/292L/296R, 96E/149E/292L/296R, 96E/174H/ 219K/231E/292L/296R, 96E/231E/296R, 146F/175G/ 189A/281K, 149E/174H/292L/296R, 149E/174H/300D, 149E/219K/231E/292L/296R/300D, 149E/231E/292L/ 296R, 149E/231E/292L/296R/300D, 149E/296R, 149E/ 296R/300D, 174H/296R, 174R/231E, 218I, 231E, 231E/ 292L/296R, 231E/292L/296R/300D, 231E/296R, 231E/ 300D, 292L/296R, 292L/296R/300D, 296R, and 296R/ 300D, wherein the amino acid positions of the polypeptide sequence are numbered with reference to SEQ ID NO: 94. In some embodiments, the polynucleotide encodes a recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 94, or a functional fragment thereof, and wherein the recombinant lipase comprises at least one substitution or substitution set selected from T3S/S4W/ I96E/S296R/Q300D, T3S/M292L/S296R, S4W, S4W/ V11A/T149E/M292L/S296R/Q300D, S4W/I96E/T149E/ Q231E/S296R/Q300D, S4W/I96E/T149E/M292L/S296R/ Q300D, S4W/I96E/A219K/S296R, S4W/I96E/Q231E/ S296R/Q300D, S4W/I96E/M292L/S296R/Q300D, S4W/ T149E/E174R, S4W/E174H/A219K/M292L/S296R, S4W/ Q231E/S296R/Q300D, Y27V, Y27V/K34D/K82E, Y27V/ T73I/K82L/H218I, Y27V/T73I/K82L/H218M, Y27V/F89T, Y27V/F89T/S178P, Y27V/F89T/H218I, Y27V/H218I, K34D/T73I/H218I, K34D/K82C, K34D/H218M, T73I/ K82C, T73I/K82L/F183L, P94S/P146F/Q175G, I96E/ T149E/E174H/M292L/S296R, I96E/T149E/Q231E/ M292L/S296R, I96E/T149E/M292L/S296R, I96E/E174H/ A219K/Q231E/M292L/S296R, I96E/Q231E/S296R, P146F/Q175G/S189A/G281K, T149E/E174H/M292L/ S296R, T149E/E174H/Q300D, T149E/A219K/Q231E/ M292L/S296R/Q300D, T149E/Q231E/M292L/S296R, T149E/Q231E/M292L/S296R/Q300D, T149E/S296R, T149E/S296R/Q300D, E174H/S296R, E174R/Q231E, H218I, Q231E, Q231E/M292L/S296R, Q231E/M292L/ S296R/Q300D, Q231E/S296R, Q231E/Q300D, M292L/ S296R, M292L/S296R/Q300D, S296R, and S296R/Q300D, wherein the amino acid positions of the polypeptide sequence are numbered with reference to SEQ ID NO: 94.

In some embodiments, the polynucleotide encodes a recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 350, or a functional fragment thereof, wherein the recombinant lipase comprises at least one substitution or substitution set at one or more positions selected from 4, 4/27/189/300, 4/70, 4/102, 4/137, 4/175/ 189/218, 4/175/189/300, 4/175/218/224, 4/175/218/373, 4/185, 4/189/218/373, 4/193, 4/218/300/369/373, 4/228, 4/233, 4/243, 4/271, 4/303, 4/334, 4/336, 4/375, 25, 27/82/ 174/175/189/218/300/369/373, 27/82/174/175/218/300/ 369, 27/82/174/175/218/300/373/382, 27/82/174/218/300/ 373, 27/189/218/373, 28, 33, 99, 102, 104, 134, 153, 174/ 175/189, 174/373, 175/189/218/300/373, 175/189/373, 175/ 218, 175/218/382, 189/218/300/373, 191, 193, 231, 233, 243, 293, 303, 331, 336, 339, 368, and 373, wherein the amino acid positions of the polypeptide sequence are numbered with reference to SEQ ID NO: 350. In some embodiments, the polynucleotide encodes a recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 350, or a functional fragment thereof, and wherein the recombinant lipase comprises at least one substitution or substitution set selected from 4W, 4W/27V/189A/300D, 4W/70H, 4W/102T, 4W/137R, 4W/175G/189A/218M, 4W/175G/189A/300D, 4W/175G/218M/224A, 4W/175G/ 218M/373F, 4W/185L, 4W/189A/218M/373F, 4W/193T, 4W/218M/300D/369N/373F, 4W/228E, 4W/233R, 4W/243R, 4W/271D, 4W/303P, 4W/334T, 4W/336S, 4W/336T, 4W/375A, 25V, 27V/82C/174H/175G/189A/ 218M/300D/369N/373F, 27V/82C/174H/175G/218M/ 300D/369N, 27V/82C/174H/175G/218M/300D/373F/ 382M, 27V/82C/174H/218M/300D/373F, 27V/189A/ 218M/373F, 28N, 33Y, 99D, 102L, 104H, 134R, 153G, 174H/175L/189A, 174H/373F, 175G/189A/218M/300D/ 373F, 175G/218M, 175G/218M/382M, 175L/189A/373F, 189A/218M/300D/373F, 191L, 193L, 231Q, 233G, 233S, 233W, 243R, 293R, 303P, 331R, 336R, 339K, 368A, 368T, and 373F, wherein the amino acid positions of the polypeptide sequence are numbered with reference to SEQ ID NO: 350. In some embodiments, the polynucleotide encodes a recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 350, or a functional fragment thereof, and wherein the recombinant lipase comprises at least one substitution or substitution set selected from S4W, S4W/Y27V/S189A/Q300D, S4W/K70H, S4W/E102T, S4W/S137R, S4W/Q175G/S189A/H218M, S4W/Q175G/ S189A/Q300D, S4W/Q175G/H218M/V224A, S4W/ Q175G/H218M/Y373F, S4W/I185L, S4W/S189A/H218M/ Y373F, S4W/Q193T, S4W/H218M/Q300D/S369N/Y373F, S4W/P228E, S4W/N233R, S4W/L243R, S4W/G271D, S4W/A303P, S4W/D334T, S4W/A336S, S4W/A336T, S4W/N375A, L25V, Y27V/K82C/E174H/Q175G/S189A/ H218M/Q300D/S369N/Y373F, Y27V/K82C/E174H/ Q175G/H218M/Q300D/S369N, Y27V/K82C/E174H/ Q175G/H218M/Q300D/Y373F/H382M, Y27V/K82C/ E174H/H218M/Q300D/Y373F, Y27V/S189A/H218M/ Y373F, R28N, L33Y, Q99D, E102L, N104H, E134R, N153G, E174H/Q175L/S189A, E174H/Y373F, Q175G/ S189A/H218M/Q300D/Y373F, Q175G/H218M, Q175G/ H218M/H382M, Q175L/S189A/Y373F, S189A/H218M/ Q300D/Y373F, A191L, Q193L, E231Q, N233G, N233S, N233W, L243R, Q293R, A303P, S331R, A336R, Q339K, F368A, F368T, and Y373F, wherein the amino acid positions of the polypeptide sequence are numbered with reference to SEQ ID NO: 350.

In some embodiments, the polynucleotide encodes a recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 442, or a functional fragment thereof, wherein the recombinant lipase comprises at least one substitution or substitution set at one or more positions selected from 26, 33, 33/174/193/243, 33/174/334, 33/175/ 218/303, 33/175/218/334/339, 33/193, 34, 38, 46, 48, 70/271/293/334, 144, 174, 174/175/193, 174/175/218/339, 174/193/303/375, 174/193/375, 174/218/233/271/293/303, 174/218/271/303, 175/193/218/233/243/375, 175/193/218/ 243, 175/218/375, 181, 189, 193, 193/218/243, 193/271/ 303/334, 193/293/303, 194, 195, 199, 210, 218, 218/243, 218/243/303/334, 218/303, 225, 238, 274, 281, and 330, wherein the amino acid positions of the polypeptide sequence are numbered with reference to SEQ ID NO: 442. In some embodiments, the polynucleotide encodes a recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 442, or a functional fragment thereof, and wherein the recombinant lipase comprises at least one substitution or substitution set selected from G26A, G26R, G26S, L33Y, L33Y/E174H/Q193L/L243R, L33Y/E174H/ D334T, L33Y/L175G/H218M/A303P, L33Y/L175G/ H218M/D334T/Q339K, L33Y/Q193L, K34L, F38A, F38G, R46P, Y48L, K70H/G271D/Q293R/D334T, I144L, E174H, E174H/L175G/Q193L, E174H/L175G/H218M/Q339K, E174H/Q193L/A303P/N375A, E174H/Q193L/N375A, E174H/H218M/N233R/G271D/Q293R/A303P, E174H/ H218M/G271D/A303P, E174R, L175G/Q193L/H218M/ N233R/L243R/N375A, L175G/Q193L/H218M/L243R, L175G/H218M/N375A, K181Q, A189H, Q193L, Q193L/ H218M/L243R, Q193L/G271D/A303P/D334T, Q193L/ Q293R/A303P, K194T, Q195I, Q195L, Q195Y, I199H, K210V, H218C, H218D, H218M, H218M/L243R, H218M/ L243R/A303P/D334T, H218M/A303P, H218P, M225L, Y238W, T274D, G281K, G281P, N330F, and N330H, wherein the amino acid positions of the polypeptide sequence are numbered with reference to SEQ ID NO: 442.

In some embodiments, the polynucleotide encodes a recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 540, or a functional fragment thereof, wherein the recombinant lipase comprises at least one substitution or substitution set at one or more positions selected from 34/38/174/193/195/243/281/303/330, 34/38/ 174/225/303, 34/38/174/303/345, 34/174, 34/174/193/195/ 243/281, 34/174/193/195/303/330, 34/193/195/225/243, 34/193/243/303/330, 34/281/330, 38, 38/174/193/195/243/ 330, 38/174/193/225/274/283/303/330, 38/174/193/303, 38/174/195/281/330, 38/174/225/243/281/330, 38/174/281, 38/174/281/303, 38/174/281/303/345, 38/193/195/225/303/ 345, 38/195/243/303, 38/195/281/303/330, 38/195/281/330, 38/195/303, 49, 49/51/98/252/311, 49/51/123/252/344, 49/98/120/252/344, 49/120/252/344, 49/123/252/344, 49/123/264/344, 49/123/311, 49/252/344, 49/311/344, 49/344, 51, 51/252/344, 51/344, 98, 98/344, 123/252/344, 129, 160, 161, 174/193/195/225, 174/193/303/330, 174/195/ 225/281/303/330/345, 174/195/243/281/345, 174/195/281/ 303, 174/225/243/281/303/345, 174/281/330, 174/303, 195/ 225/303/330, 252, 268, and 344, wherein the amino acid positions of the polypeptide sequence are numbered with reference to SEQ ID NO: 540. In some embodiments, the polynucleotide encodes a recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 540, or a functional fragment thereof, and wherein the recombinant lipase comprises at least one substitution or substitution set selected from 34L/38A/174I/193L/195L/243R/281P/303P/ 330F, 34L/38A/174R/303P/345I, 34L/38G/174R/225L/ 303P, 34L/174G, 34L/174G/193L/195L/243R/281P, 34L/ 174H/193L/195I/303P/330F, 34L/193L/195I/225L/243R, 34L/193L/243R/303P/330F, 34L/281P/330H, 38A/174H/ 193L/225L/274D/283I/303P/330F, 38A/174R/281K/303P/ 345I, 38A/193L/195L/225L/303P/345I, 38A/195I/303P, 38A/195Y/281K/303P/330F, 38G, 38G/174G/193L/303P, 38G/174G/281K/303P, 38G/174H/195L/281P/330F, 38G/ 174H/225L/243R/281K/330H, 38G/174H/281K, 38G/ 174R/193L/195L/243R/330H, 38G/195I/281P/330F, 38G/ 195Y/243R/303P, 49S, 49T, 49T/51A/98P/252V/311W, 49T/51A/123Q/252V/344H, 49T/98P/120T/252V/344H, 49T/120T/252V/344H, 49T/123Q/252V/344H, 49T/123Q/ 264S/344H, 49T/123Q/311W, 49T/252V/344H, 49T/311W/ 344H, 49T/344H, 51A/252V/344H, 51A/344H, 51V, 98P/ 344H, 98R, 123Q/252V/344H, 129F, 160T, 161I, 174G/ 195I/225L/281K/303P/330F/345I, 174G/225L/243R/281P/ 303P/345I, 174H/195I/243R/281K/345I, 174H/281P/330H, 174R/193L/195I/225L, 174R/193L/303P/330H, 174R/195I/ 281K/303P, 174R/303P, 195Y/225L/303P/330H, 252V, 268T, 344I, 344V, and 344W, wherein the amino acid positions of the polypeptide sequence are numbered with reference to SEQ ID NO: 540. In some embodiments, the polynucleotide encodes a recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 540, or a functional fragment thereof, and wherein the recombinant lipase comprises at least one substitution or substitution set selected from K34L/F38A/E174G/Q193L/Q195L/L243R/ G281P/A303P/N330F, K34L/F38A/E174R/A303P/F345I, K34L/F38G/E174R/M225L/A303P, K34L/E174G, K34L/ E174G/Q193L/Q195L/L243R/G281P, K34L/E174H/ Q193L/Q195I/A303P/N330F, K34L/Q193L/Q195I/M225L/ L243R, K34L/Q193L/L243R/A303P/N330F, K34L/G281P/ N330H, F38A/E174H/Q193L/M225L/T274D/M283I/ A303P/N330F, F38A/E174R/G281K/A303P/F345I, F38A/ Q193L/Q195L/M225L/A303P/F345I, F38A/Q195I/A303P, F38A/Q195Y/G281K/A303P/N330F, F38G, F38G/E174G/ Q193L/A303P, F38G/E174G/G281K/A303P, F38G/E174H/ Q195L/G281P/N330F, F38G/E174H/M225L/L243R/ G281K/N330H, F38G/E174H/G281K, F38G/E174R/ Q193L/Q195L/L243R/N330H, F38G/Q195I/G281P/ N330F, F38G/Q195Y/L243R/A303P, V49S, V49T, V49T/ T51A/G98P/M252V/L311W, V49T/T51A/E123Q/M252V/ S344H, V49T/G98P/M120T/M252V/S344H, V49T/ M120T/M252V/S344H, V49T/E123Q/M252V/S344H, V49T/E123Q/T264S/S344H, V49T/E123Q/L311W, V49T/ M252V/S344H, V49T/L311W/S344H, V49T/S344H, T51A/M252V/S344H, T51A/S344H, T51V, G98P/S344H, G98R, E123Q/M252V/S344H, S129F, S160T, L161I, E174G/Q195I/M225L/G281K/A303P/N330F/F345I, E174G/M225L/L243R/G281P/A303P/F345I, E174H/ Q195I/L243R/G281K/F345I, E174H/G281P/N330H, E174R/Q193L/Q195I/M225L, E174R/Q193L/A303P/ N330H, E174R/Q195I/G281K/A303P, E174R/A303P, Q195Y/M225L/A303P/N330H, M252V, S268T, S344I, S344V, and S344W, wherein the amino acid positions of the polypeptide sequence are numbered with reference to SEQ ID NO: 540.

In some embodiments, the polynucleotide encodes a recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 646, or a functional fragment thereof, wherein the recombinant lipase comprises at least one substitution or substitution set at one or more positions selected from 11/16/67/168/180/287, 11/16/237/241/287, 11/67/168/287, 16/67/154/168/237/241/287, 16/67/237/287/ 291, 16/168/177, 24, 24/278, 34/49/161/193/243/344, 34/49/161/193/344, 34/49/161/243/344, 34/49/161/252/ 268/344, 34/49/193/243/252/344, 34/49/193/344, 34/49/ 243/252, 34/49/252/268/344, 34/161/193/243/252/268, 34/161/193/243/268/344, 34/161/193/243/344, 34/161/193/ 252/268/344, 34/161/193/252/344, 34/161/193/268/344, 34/161/243/281/344, 34/161/344, 34/193/243/252/344, 34/193/252/268/344, 34/193/268/281, 34/252/268/281/344, 34/252/344, 49/161/193/243/252/344, 49/161/193/252/281/ 344, 49/161/243/252/344, 49/193/197/243/252/281/344, 49/193/243/252/344, 49/193/243/344, 49/243/344, 67/154/ 237/287, 67/168/237, 67/168/237/287, 67/177/237, 154/ 237/286/287, 154/286/287, 161/193/252/344, 161/193/344, 161/344, 168/237, 186/187/278, 193/243/281/344, 193/252/ 268/344, 193/252/281/344, 237, 237/287/291, and 281/344, wherein the amino acid positions of the polypeptide sequence are numbered with reference to SEQ ID NO: 646. In some embodiments, the polynucleotide encodes a recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 646, or a functional fragment thereof, and wherein the recombinant lipase comprises at least one substitution or substitution set selected from 11I/16F/67A/ 168T/180V/287L, 11I/16F/237Q/241S/287L, 11I/67A/ 168T/287L, 16F/67A/154Y/168T/237Q/241S/287L, 16F/ 67A/237Q/287L/291A, 16F/168T/177L, 24M, 24M/278L, 34K/49T/161I/193L/243R/344H, 34K/49T/161I/193L/ 243R/344V, 34K/49T/161I/193L/344W, 34K/49T/161I/ 243R/344H, 34K/49T/161I/252V/268T/344V, 34K/49T/ 193L/243R/252V/344W, 34K/49T/193L/344H, 34K/49T/ 193L/344W, 34K/49T/243R/252V, 34K/49T/252V/268T/ 344V, 34K/161I/193L/243R/252V/268T, 34K/161I/193L/ 243R/268T/344V, 34K/161I/193L/243R/344W, 34K/161I/ 193L/252V/268T/344H, 34K/161I/193L/252V/268T/344V, 34K/161I/193L/252V/344H, 34K/161I/193L/252V/344V, 34K/161I/193L/252V/344W, 34K/161I/193L/268T/344H, 34K/161I/243R/281P/344V, 34K/161I/344V, 34K/161I/ 344W, 34K/193L/243R/252V/344W, 34K/193L/252V/ 268T/344H, 34K/193L/268T/281P, 34K/252V/268T/281P/ 344V, 34K/252V/344V, 49T/161I/193L/243R/252V/344W, 49T/161I/193L/252V/281P/344H, 49T/161I/243R/252V/ 344V, 49T/193L/197G/243R/252V/281P/344H, 49T/193L/ 243R/252V/344V, 49T/193L/243R/344W, 49T/243R/344V, 67A/154Y/237Q/287L, 67A/168T/237Q, 67A/168T/237Q/ 287L, 67A/177L/237Q, 154Y/237Q/286V/287L, 154Y/ 286V/287L, 161I/193L/252V/344V, 161I/193L/344W, 161I/344W, 168T/237Q, 186T/187A/278L, 193L/243R/ 281P/344W, 193L/252V/268T/344H, 193L/252V/281P/ 344H, 237Q, 237Q/287L/291A, and 281P/344W, wherein the amino acid positions of the polypeptide sequence are numbered with reference to SEQ ID NO: 646. In some embodiments, the polynucleotide encodes a recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 646, or a functional fragment thereof, and wherein the recombinant lipase comprises at least one substitution or substitution set selected from V11I/L16F/ Y67A/S168T/I180V/F287L, V11I/L16F/A237Q/T241S/ F287L, V11I/Y67A/S168T/F287L, L16F/Y67A/W154Y/

S168T/A237Q/T241S/F287L, L16F/Y67A/A237Q/F287L/ S291A, L16F/S168T/V177L, F24M, F24M/Y278L, L34K/ V49T/L161I/Q193L/L243R/S344H, L34K/V49T/L161I/ Q193L/L243R/S344V, L34K/V49T/L161I/Q193L/S344W, L34K/V49T/L161I/L243R/S344H, L34K/V49T/L161I/ M252V/S268T/S344V, L34K/V49T/Q193L/L243R/ M252V/S344W, L34K/V49T/Q193L/S344H, L34K/V49T/ Q193L/S344W, L34K/V49T/L243R/M252V, L34K/V49T/ M252V/S268T/S344V, L34K/L161I/Q193L/L243R/ M252V/S268T, L34K/L161I/Q193L/L243R/S268T/S344V, L34K/L161I/Q193L/L243R/S344W, L34K/L161I/Q193L/ M252V/S268T/S344H, L34K/L161I/Q193L/M252V/ S268T/S344V, L34K/L161I/Q193L/M252V/S344H, L34K/ L161I/Q193L/M252V/S344V, L34K/L161I/Q193L/ M252V/S344W, L34K/L161I/Q193L/S268T/S344H, L34K/ L161I/L243R/G281P/S344V, L34K/L161I/S344V, L34K/ L161I/S344W, L34K/Q193L/L243R/M252V/S344W, L34K/Q193L/M252V/S268T/S344H, L34K/Q193L/S268T/ G281P, L34K/M252V/S268T/G281P/S344V, L34K/ M252V/S344V, V49T/L161I/Q193L/L243R/M252V/ S344W, V49T/L161I/Q193L/M252V/G281P/S344H, V49T/L161I/L243R/M252V/S344V, V49T/Q193L/S197G/ L243R/M252V/G281P/S344H, V49T/Q193L/L243R/ M252V/S344V, V49T/Q193L/L243R/S344W, V49T/ L243R/S344V, Y67A/W154Y/A237Q/F287L, Y67A/ S168T/A237Q, Y67A/S168T/A237Q/F287L, Y67A/ V177L/A237Q, W154Y/A237Q/L286V/F287L, W154Y/ L286V/F287L, L161I/Q193L/M252V/S344V, L161I/ Q193L/S344W, L161I/S344W, S168T/A237Q, H186T/ L187A/Y278L, Q193L/L243R/G281P/S344W, Q193L/ M252V/S268T/S344V, Q193L/M252V/G281P/S344H, A237Q, A237Q/F287L/S291A, and G281P/S344W, wherein the amino acid positions of the polypeptide sequence are numbered with reference to SEQ ID NO: 646.

In some embodiments, the polynucleotide encodes a recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 758, or a functional fragment thereof, wherein the recombinant lipase comprises at least one substitution or substitution set at one or more positions selected from 24/168/252/281, 24/237/287/344, 24/252, 24/252/287, 24/344, 213/252/278/344, 252/278/344, 252/ 287/344, and 281, wherein the amino acid positions of the polypeptide sequence are numbered with reference to SEQ ID NO: 758. In some embodiments, the polynucleotide encodes a recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 758, or a functional fragment thereof, and wherein the recombinant lipase comprises at least one substitution or substitution set selected from 24M/168T/252V/281P, 24M/237Q/287L/344S, 24M/ 252V, 24M/252V/287L, 24M/344W, 213S/252V/278L/ 344S, 252V/278L/344W, 252V/287L/344S, and 281P, wherein the amino acid positions of the polypeptide sequence are numbered with reference to SEQ ID NO: 758. In some embodiments, the polynucleotide encodes a recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 758, or a functional fragment thereof, and wherein the recombinant lipase comprises at least one substitution or substitution set selected from F24M/S168T/ M252V/G281P, F24M/A237Q/F287L/H344S, F24M/ M252V, F24M/M252V/F287L, F24M/H344W, P213S/ M252V/Y278L/H344S, M252V/Y278L/H344W, M252V/ F287L/H344S, and G281P, wherein the amino acid positions of the polypeptide sequence are numbered with reference to SEQ ID NO: 758.

In some embodiments, the polynucleotide encodes a recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 868, or a functional fragment thereof, wherein the recombinant lipase comprises at least one substitution or substitution set at one or more positions selected from 24, 24/38/49/70/149/161/174/175/189/193/ 225/231/243/252/271/287/292/293/296/303/334/344/373/ 385, 38, 49, 70, 149, 161, 174, 175, 189, 193, 225, 231, 243, 252, 271, 287, 292, 293, 296, 303, 334, 344, 373, and 385, wherein the amino acid positions of the polypeptide sequence are numbered with reference to SEQ ID NO: 868. In some embodiments, the polynucleotide encodes a recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 868, or a functional fragment thereof, and wherein the recombinant lipase comprises at least one substitution or substitution set selected from 24A, 24C, 24D, 24E, 24F, 24F/38F/49V/70K/149T/161L/174E/175Q/189S/ 193Q/225M/231Q/243L/252M/271G/287F/292M/293Q/ 296S/303A/334D/344S/373Y/385F, 24G, 24H, 24I, 24K, 24L, 24N, 24P, 24Q, 24R, 24S, 24T, 24V, 24W, 24Y, 38A, 38C, 38D, 38E, 38F, 38H, 38I, 38K, 38L, 38M, 38N, 38P, 38Q, 38R, 38S, 38T, 38V, 38W, 38Y, 49A, 49C, 49D, 49E, 49F, 49G, 49H, 49I, 49K, 49L, 49M, 49N, 49P, 49Q, 49R, 49S, 49V, 49W, 49Y, 70A, 70C, 70D, 70E, 70F, 70G, 70I, 70K, 70L, 70M, 70N, 70P, 70Q, 70R, 70S, 70T, 70V, 70W, 70Y, 149A, 149C, 149D, 149F, 149G, 149H, 149I, 149K, 149L, 149M, 149N, 149P, 149Q, 149R, 149S, 149T, 149V, 149W, 149Y, 161A, 161C, 161D, 161E, 161F, 161G, 161H, 161K, 161L, 161M, 161N, 161P, 161Q, 161R, 161S, 161T, 161V, 161W, 161Y, 174A, 174C, 174D, 174E, 174F, 174G, 174H, 174I, 174K, 174L, 174M, 174N, 174P, 174Q, 174S, 174T, 174V, 174W, 174Y, 175A, 175C, 175D, 175E, 175F, 175G, 175H, 175I, 175K, 175M, 175N, 175P, 175Q, 175R, 175S, 175T, 175V, 175W, 175Y, 189C, 189D, 189E, 189F, 189G, 189H, 189I, 189K, 189L, 189M, 189N, 189P, 189Q, 189R, 189S, 189T, 189V, 189W, 189Y, 193A, 193C, 193D, 193E, 193F, 193G, 193H, 193I, 193K, 193M, 193N, 193P, 193Q, 193R, 193S, 193T, 193V, 193W, 193Y, 225A, 225C, 225D, 225E, 225F, 225G, 225H, 225I, 225K, 225M, 225N, 225P, 225Q, 225R, 225S, 225T, 225V, 225W, 225Y, 231A, 231C, 231D, 231F, 231G, 231H, 231I, 231K, 231L, 231M, 231N, 231P, 231Q, 231R, 231S, 231T, 231V, 231W, 231Y, 243A, 243C, 243D, 243E, 243F, 243G, 243H, 243I, 243K, 243L, 243M, 243N, 243P, 243Q, 243S, 243T, 243V, 243W, 243Y, 252A, 252C, 252D, 252E, 252F, 252G, 252H, 252I, 252K, 252L, 252M, 252N, 252P, 252Q, 252R, 252S, 252T, 252W, 252Y, 271A, 271C, 271E, 271F, 271G, 271H, 271I, 271K, 271L, 271M, 271N, 271P, 271Q, 271R, 271S, 271T, 271V, 271W, 271Y, 287A, 287C, 287D, 287E, 287F, 287G, 287H, 287I, 287K, 287M, 287N, 287P, 287Q, 287R, 287S, 287T, 287V, 287W, 287Y, 292A, 292C, 292D, 292E, 292F, 292G, 292H, 292I, 292K, 292M, 292N, 292P, 292Q, 292R, 292S, 292T, 292V, 292W, 292Y, 293A, 293C, 293D, 293E, 293F, 293G, 293H, 293I, 293K, 293L, 293M, 293N, 293P, 293Q, 293S, 293T, 293V, 293W, 293Y, 296A, 296C, 296D, 296E, 296F, 296G, 296H, 296I, 296K, 296L, 296M, 296N, 296P, 296Q, 296S, 296T, 296V, 296W, 296Y, 303A, 303C, 303D, 303E, 303F, 303G, 303H, 303I, 303K, 303L, 303M, 303N, 303Q, 303R, 303S, 303T, 303V, 303W, 303Y, 334A, 334C, 334D, 334E, 334F, 334G, 334H, 334I, 334K, 334L, 334M, 334N, 334P, 334Q, 334R, 334S, 334V, 334W, 334Y, 344A, 344C, 344D, 344E, 344F, 344G, 344I, 344K, 344L, 344M, 344N, 344P, 344Q, 344R, 344S, 344T, 344V, 344W, 344Y, 373A, 373C, 373D, 373E, 373G, 373H, 373I, 373K, 373L, 373M, 373N, 373P, 373Q, 373R, 373S, 373T, 373V, 373W, 373Y, 385A, 385C, 385D, 385E, 385F, 385G, 385H, 385I, 385K, 385L, 385M, 385N, 385Q, 385R, 385S, 385T, 385V, 385W, and 385Y, wherein the amino acid positions of the polypeptide sequence are numbered with reference to SEQ ID NO: 868. In some embodiments, the polynucleotide encodes a recombinant lipase comprising a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 868, or a functional fragment thereof, and wherein the recombinant lipase comprises at least one substitution or substitution set selected from M24A, M24C, M24D, M24E, M24F, M24F/G38F/T49V/H70K/E149T/I161L/R174E/L175Q/A189S/L193Q/L225M/E231Q/R243L/V252M/D271G/L287F/L292M/R293Q/R296S/P303A/T334D/H344S/F373Y/P385F, M24G, M24H, M24I, M24K, M24L, M24N, M24P, M24Q, M24R, M24S, M24T, M24V, M24W, M24Y, G38A, G38C, G38D, G38E, G38F, G38H, G38I, G38K, G38L, G38M, G38N, G38P, G38Q, G38R, G38S, G38T, G38V, G38W, G38Y, T49A, T49C, T49D, T49E, T49F, T49G, T49H, T49I, T49K, T49L, T49M, T49N, T49P, T49Q, T49R, T49S, T49V, T49W, T49Y, H70A, H70C, H70D, H70E, H70F, H70G, H70I, H70K, H70L, H70M, H70N, H70P, H70Q, H70R, H70S, H70T, H70V, H70W, H70Y, E149A, E149C, E149D, E149F, E149G, E149H, E149I, E149K, E149L, E149M, E149N, E149P, E149Q, E149R, E149S, E149T, E149V, E149W, E149Y, I161A, I161C, I161D, I161E, I161F, I161G, I161H, I161K, I161L, I161M, I161N, I161P, I161Q, I161R, I161S, I161T, I161V, I161W, I161Y, R174A, R174C, R174D, R174E, R174F, R174G, R174H, R174I, R174K, R174L, R174M, R174N, R174P, R174Q, R174S, R174T, R174V, R174W, R174Y, L175A, L175C, L175D, L175E, L175F, L175G, L175H, L175I, L175K, L175M, L175N, L175P, L175Q, L175R, L175S, L175T, L175V, L175W, L175Y, A189C, A189D, A189E, A189F, A189G, A189H, A189I, A189K, A189L, A189M, A189N, A189P, A189Q, A189R, A189S, A189T, A189V, A189W, A189Y, L193A, L193C, L193D, L193E, L193F, L193G, L193H, L193I, L193K, L193M, L193N, L193P, L193Q, L193R, L193S, L193T, L193V, L193W, L193Y, L225A, L225C, L225D, L225E, L225F, L225G, L225H, L225I, L225K, L225M, L225N, L225P, L225Q, L225R, L225S, L225T, L225V, L225W, L225Y, E231A, E231C, E231D, E231F, E231G, E231H, E231I, E231K, E231L, E231M, E231N, E231P, E231Q, E231R, E231S, E231T, E231V, E231W, E231Y, R243A, R243C, R243D, R243E, R243F, R243G, R243H, R243I, R243K, R243L, R243M, R243N, R243P, R243Q, R243S, R243T, R243V, R243W, R243Y, V252A, V252C, V252D, V252E, V252F, V252G, V252H, V252I, V252K, V252L, V252M, V252N, V252P, V252Q, V252R, V252S, V252T, V252W, V252Y, D271A, D271C, D271E, D271F, D271G, D271H, D271I, D271K, D271L, D271M, D271N, D271P, D271Q, D271R, D271S, D271T, D271V, D271W, D271Y, L287A, L287C, L287D, L287E, L287F, L287G, L287H, L287I, L287K, L287M, L287N, L287P, L287Q, L287R, L287S, L287T, L287V, L287W, L287Y, L292A, L292C, L292D, L292E, L292F, L292G, L292H, L292I, L292K, L292M, L292N, L292P, L292Q, L292R, L292S, L292T, L292V, L292W, L292Y, R293A, R293C, R293D, R293E, R293F, R293G, R293H, R293I, R293K, R293L, R293M, R293N, R293P, R293Q, R293S, R293T, R293V, R293W, R293Y, R296A, R296C, R296D, R296E, R296F, R296G, R296H, R296I, R296K, R296L, R296M, R296N, R296P, R296Q, R296S, R296T, R296V, R296W, R296Y, P303A, P303C, P303D, P303E, P303F, P303G, P303H, P303I, P303K, P303L, P303M, P303N, P303Q, P303R, P303S, P303T, P303V, P303W, P303Y, T334A, T334C, T334D, T334E, T334F, T334G, T334H, T334I, T334K, T334L, T334M, T334N, T334P, T334Q, T334R, T334S, T334V, T334W, T334Y, H344A, H344C, H344D, H344E, H344F, H344G, H344I, H344K, H344L, H344M, H344N, H344P, H344Q, H344R, H344S, H344T, H344V, H344W, H344Y, F373A, F373C, F373D, F373E, F373G, F373H, F373I, F373K, F373L, F373M, F373N, F373P, F373Q, F373R, F373S, F373T, F373V, F373W, F373Y, P385A, P385C, P385D, P385E, P385F, P385G, P385H, P385I, P385K, P385L, P385M, P385N, P385Q, P385R, P385S, P385T, P385V, P385W, and P385Y, wherein the amino acid positions of the polypeptide sequence are numbered with reference to SEQ ID NO: 868.

In some embodiments, as described above, the polynucleotide encodes an engineered polypeptide having lipase activity with the properties disclosed herein, wherein the polypeptide comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99% or more identity to a reference sequence (e.g., SEQ ID NO: 2, 94, 350, 442, 540, 646, 758, and/or 868), or the amino acid sequence of any variant as disclosed in Table 4-1, 4-2, 4-3, 4-4, 4-5, 4-6, 4-7, and/or 5-1, and one or more residue differences as compared to the reference polypeptide of SEQ ID NO: 2, 94, 350, 442, 540, 646, 758, and/or 868, or the amino acid sequence of any variant as disclosed in the Tables (for example 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more amino acid residue positions). In some embodiments, the polynucleotide encodes an engineered polypeptide having lipase activity with the properties disclosed herein, wherein the polypeptide comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99% or more sequence identity to reference sequence SEQ ID NO: 2, 94, 350, 442, 540, 646, 758, and/or 868, and one or more residue differences as compared to SEQ ID NO: 2, 94, 350, 442, 540, 646, 758, and/or 868, at residue positions selected from those provided in Table 4-1, 4-2, 4-3, 4-4, 4-5, 4-6, 4-7, and/or 5-1, when optimally aligned with the polypeptide of SEQ ID NO: 2, 94, 350, 442, 540, 646, 758, and/or 868.

In some additional embodiments, the polynucleotide comprises a sequence having at least about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99% or more sequence identity to reference sequence 1, 93, 349, 441, 539, 645, 757, and/or 867. In some additional embodiments, the polynucleotide comprises a sequence having at least about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99% or more sequence identity to at least one polynucleotide sequence provided in Table 4-1, 4-2, 4-3, 4-4, 4-5, 4-6, 4-7, and/or 5-1. In some additional embodiments, the polynucleotide comprises a sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to reference sequence 1, 93, 349, 441, 539, 645, 757, and/or 867. In some additional embodiments, the polynucleotide comprises a sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to at least one polynucleotide sequence provided in Table 4-1, 4-2, 4-3, 4-4, 4-5, 4-6, 4-7, and/or 5-1. In some embodiments, the polynucleotide encoding the engineered lipase polypeptides comprises the polynucleotide sequence of SEQ ID NO: 93, 349, 441, 539, 645, 757, and/or 867.

In some embodiments, the polynucleotides are capable of hybridizing under highly stringent conditions to a reference polynucleotide sequence. In some embodiments, the reference sequence is selected from SEQ ID NOS: 1, 93, 349, 441, 539, 645, 757, and/or 867, or a complement thereof, or a polynucleotide sequence encoding any of the variant lipase polypeptides provided herein. In some embodiments, the polynucleotide capable of hybridizing under highly stringent conditions encodes a lipase polypeptide comprising an amino acid sequence that has one or more residue differences as compared to SEQ ID NO: 1, 93, 349, 441, 539, 645, 757, and/or 867, at residue positions selected from any positions as set forth in Table 4-1, 4-2, 4-3, 4-4, 4-5, 4-6, 4-7, and/or 5-1. In some further embodiments, the engineered polynucleotide is selected from those provided in Table 4-1, 4-2, 4-3, 4-4, 4-5, 4-6, 4-7, and/or 5-1, or comprises a polynucleotide having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to a reference sequence selected from SEQ ID NO: 1, 93, 349, 441, 539, 645, 757, and/or 867. In some additional embodiments, the polynucleotide comprises a sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to at least one polynucleotide sequence provided in Table 4-1, 4-2, 4-3, 4-4, 4-5, 4-6, 4-7, and/or 5-1, and/or SEQ ID NO: 1, 93, 349, 441, 539, 645, 757, and/or 867. In some further embodiments, the engineered polynucleotide sequence comprises 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 base changes, as compared to a reference polynucleotide sequence. In still some other embodiments, the engineered polynucleotide sequence comprises 1, 2, 3, 4, 5, 6, 7, 8, 9, 10, 11, 12, 13, 14, 15, 16, 17, 18, 19, 20, 21, 22, 23, 24, 25, 30, 31, 32, 33, 34, 35, 40, 45, or 50 base changes, as compared to a reference polynucleotide sequence. In some embodiments, the engineered polynucleotide sequence comprises 1, 2, 3, 4, 5, 6, 7, 8, 9, 10, 11, 12, 13, 14, 15, 16, 18, 20, 21, 22, 23, 24, or 25 base changes, as compared to a reference polynucleotide sequence.

In some embodiments, an isolated polynucleotide encoding any of the engineered lipase polypeptides provided herein is manipulated in a variety of ways to provide for expression of the gene and production of the polypeptide. In some embodiments, the polynucleotides encoding the polypeptides are provided as expression vectors, in which one or more control sequences is present to regulate the expression of the polynucleotides and/or polypeptides. Manipulation of the isolated polynucleotide prior to its insertion into a vector may be desirable or necessary depending on the expression vector. The techniques for modifying polynucleotides and nucleic acid sequences utilizing recombinant DNA methods are well known in the art.

In some embodiments, the control sequences include among other sequences, promoters, leader sequences, polyadenylation sequences, propeptide sequences, signal peptide sequences, and transcription terminators. As known in the art, suitable control sequences can be selected based on the host cells used. It is not intended that the present invention be limited to any specific control sequences.

Exemplary promoters for bacterial host cells include, but are not limited to promoters obtained from the genes for *Escherichia coli* lactose operon, tryptophan operon, arabinose operon, T7 promoter from the T7 bacteriophage, and *Saccharopolyspora erythraea* erythromycin resistance gene.

Exemplary promoters for filamentous fungal host cells, include promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase, *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (See e.g., WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are known in the art (See e.g., Romanos et al., Yeast 8:423-488 [1992]).

Exemplary promoters for use in mammalian cells include, but are not limited to those from cytomegalovirus (CMV), Simian vacuolating virus 40 (SV40), from *Homo sapiens* phosphoglycerate kinase, beta actin, elongation factor-1a or glyceraldehyde-3-phosphate dehydrogenase, or from *Gallus gallus* β-actin.

In some embodiments, the control sequence is a suitable transcription terminator sequence, a sequence recognized by a host cell to terminate transcription. The terminator sequence is operably linked to the 3' terminus of the nucleic acid sequence encoding the polypeptide. Any terminator which is functional in the host cell of choice finds use in the present invention. For example, exemplary transcription terminators for bacterial host cells can be obtained from the T7 bacterial phage for the T7 terminator, or *Escherichia coli* ribosomal RNA, for example the rrnB terminator. For example, exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are known in the art (See e.g., Romanos et al., supra). Exemplary terminators for mammalian cells include, but are not limited to those from cytomegalovirus (CMV), Simian vacuolating virus 40 (SV40), or from *Homo sapiens* growth hormone.

In some embodiments, the control sequence is a suitable leader sequence, a non-translated region of an mRNA that is important for translation by the host cell. The leader sequence is operably linked to the 5' terminus of the nucleic acid sequence encoding the polypeptide. Any leader sequence that is functional in the host cell of choice may be used. Exemplary leaders for filamentous fungal host cells are obtained from the genes for *Aspergillus oryzae* TAKA amylase and *Aspergillus nidulans* triose phosphate isomerase. Suitable leaders for yeast host cells include, but are not limited to those obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

In some embodiments, the control sequence may also be a polyadenylation sequence, a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice may be used in the present invention. Exemplary polyadenylation sequences for filamentous fungal host cells include, but are not limited to those from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are also known in the art (See e.g., Guo and Sherman, Mol. Cell. Biol., 15:5983-5990 [1995]).

In some embodiments, the control sequence is a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence.

Any signal peptide coding region that directs the expressed polypeptide into the secretory pathway of a host cell of choice finds use for expression of the engineered lipase polypeptides provided herein. Effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells include, but are not limited to those from the genes for *Saccharomyces cerevisiae* alpha-factor and *Saccharomyces cerevisiae* invertase. Useful signal peptides for mammalian host cells include but are not limited to those from the genes for immunoglobulin gamma (IgG).

In some embodiments, the control sequence is a propeptide coding region that codes for an amino acid sequence positioned at the amino terminus of a polypeptide. The resultant polypeptide is referred to as a "proenzyme," "propolypeptide," or "zymogen," in some cases). A propolypeptide can be converted to a mature active polypeptide by catalytic or autocatalytic cleavage of the propeptide from the propolypeptide.

In another aspect, the present invention also provides a recombinant expression vector comprising a polynucleotide encoding an engineered lipase polypeptide, and one or more expression regulating regions such as a promoter and a terminator, a replication origin, etc., depending on the type of hosts into which they are to be introduced. in some embodiments, the various nucleic acid and control sequences described above are joined together to produce a recombinant expression vector which includes one or more convenient restriction sites to allow for insertion or substitution of the nucleic acid sequence encoding the variant lipase polypeptide at such sites. Alternatively, the polynucleotide sequence(s) of the present invention are expressed by inserting the polynucleotide sequence or a nucleic acid construct comprising the polynucleotide sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus), that can be conveniently subjected to recombinant DNA procedures and can result in the expression of the variant lipase polynucleotide sequence. The choice of the vector will typically depend on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

In some embodiments, the expression vector preferably contains one or more selectable markers, which permit easy selection of transformed cells. A "selectable marker" is a gene the product of which provides for biocide or viral resistance, resistance to heavy metals, prototrophy to auxotrophs, and the like. Suitable markers for bacterial host cells include, but are not limited to carbenicillin, ampicillin, chloramphenicol, tetracycline, kanamycin and zeocin. Suitable markers for yeast host cells include, but are not limited to ADE2, HIS3, LEU2, LYS2, MET3, TRP1, and URA3. Selectable markers for use in a filamentous fungal host cell include, but are not limited to, amdS (acetamidase), argB (ornithine carbamoyltransferases), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. In another aspect, the present invention provides a host cell comprising a polynucleotide encoding at least one engineered lipase polypeptide of the present application, the polynucleotide being operatively linked to one or more control sequences for expression of the engineered lipase enzyme(s) in the host cell.

Host cells for use in expressing the polypeptides encoded by the expression vectors of the present invention are well known in the art and include but are not limited to, bacterial cells (e.g., *E. coli*); fungal cells, such as yeast cells (e.g., *Saccharomyces cerevisiae* and *Pichia pastoris* [e.g., ATCC Accession No. 201178]); insect cells (e.g., *Drosophila* S2 and *Spodoptera* Sf9 cells), plant cells, animal cells (e.g., CHO, COS, and BHK), and human cells (e.g., HEK293T, human fibroblast, THP-1, Jurkat and Bowes melanoma cell lines).

Accordingly, in another aspect, the present invention provides methods for producing the engineered lipase polypeptides, where the methods comprise culturing a host cell capable of expressing a polynucleotide encoding the engineered lipase polypeptide under conditions suitable for expression of the polypeptide. In some embodiments, the methods further comprise the steps of isolating and/or purifying the lipase polypeptides, as described herein.

Appropriate culture media and growth conditions for the above-described host cells are well known in the art. Polynucleotides for expression of the lipase may be introduced into cells by various methods known in the art. Techniques include, among others, electroporation, biolistic particle bombardment, liposome mediated transfection, calcium chloride transfection, and protoplast fusion.

The engineered lipase with the properties disclosed herein can be obtained by subjecting the polynucleotide encoding the naturally occurring or engineered lipase polypeptide to mutagenesis and/or directed evolution methods known in the art, and as described herein. An exemplary directed evolution technique is mutagenesis and/or DNA shuffling (See e.g., Stemmer, Proc. Natl. Acad. Sci. USA 91:10747-10751 [1994]; WO 95/22625; WO 97/0078; WO 97/35966; WO 98/27230; WO 00/42651; WO 01/75767 and U.S. Pat. No. 6,537,746). Other directed evolution procedures that can be used include, among others, staggered extension process (StEP), in vitro recombination (See e.g., Zhao et al., Nat. Biotechnol., 16:258-261 [1998]), mutagenic PCR (See e.g., Caldwell et al., PCR Methods Appl., 3:S136-S140 [1994]), and cassette mutagenesis (See e.g., Black et al., Proc. Natl. Acad. Sci. USA 93:3525-3529 [1996]).

Recombinant polypeptides can be produced using any suitable methods known in the art. Genes encoding the wild-type polypeptide of interest can be cloned in vectors, such as plasmids, and expressed in desired hosts, such as E. coli, etc. Variants of recombinant polypeptides can be generated by various methods known in the art. Indeed, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Mutagenesis and directed evolution methods can be readily applied to enzyme-encoding polynucleotides to generate variant libraries that can be expressed, screened, and assayed. Any suitable mutagenesis and directed evolution methods find use in the present invention and are well known in the art (See e.g., U.S. Pat. Nos. 5,605,793, 5,811,238, 5,830,721, 5,834,252, 5,837,458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 8,849,575, 9,593,326, 9,665,694, 9,684,771, 9,803,224, 9,864,833, 9,821,613, 9,996,661, 10,738,286, and all related US, as well as PCT and non-US counterparts; Ling et al., Anal. Biochem., 254(2):157-78 [1997]; Dale et al., Meth. Mol. Biol., 57:369-74 [1996]; Smith, Ann. Rev. Genet., 19:423-462 [1985]; Botstein et al., Science, 229:1193-1201 [1985]; Carter, Biochem. J., 237: 1-7 [1986]; Kramer et al., Cell, 38:879-887 [1984]; Wells et al., Gene, 34:315-323 [1985]; Minshull et al., Curr. Op. Chem. Biol., 3:284-290 [1999]; Christians et al., Nat. Biotechnol., 17:259-264 [1999]; Crameri et al., Nature, 391: 288-291 [1998]; Crameri, et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; Stemmer, Proc. Nat. Acad. Sci. USA, 91:10747-10751 [1994]; WO 95/22625; WO 97/0078; WO 97/35966; WO 98/27230; WO 00/42651; WO 01/75767; and WO 2009/152336, all of which are incorporated herein by reference).

In some embodiments, the enzyme variants obtained following mutagenesis treatment are screened by subjecting the enzyme variants to a defined temperature (or other assay conditions) and measuring the amount of enzyme activity remaining after heat treatments or other assay conditions. DNA containing the polynucleotide encoding the lipase polypeptide is then isolated from the host cell, sequenced to identify the nucleotide sequence changes (if any), and used to express the enzyme in a different or the same host cell. Measuring enzyme activity from the expression libraries can be performed using any suitable method known in the art (e.g., standard biochemistry techniques, such as HPLC analysis).

For engineered polypeptides of known sequence, the polynucleotides encoding the enzyme can be prepared by standard solid-phase methods, according to known synthetic methods. In some embodiments, fragments of up to about 100 bases can be individually synthesized, then joined (e.g., by enzymatic or chemical ligation methods, or polymerase mediated methods) to form any desired continuous sequence. For example, polynucleotides and oligonucleotides disclosed herein can be prepared by chemical synthesis using the classical phosphoramidite method (See e.g., Beaucage et al., Tetra. Lett., 22:1859-69 [1981]; and Matthes et al., EMBO J., 3:801-05 [1984]), as it is typically practiced in automated synthetic methods. According to the phosphoramidite method, oligonucleotides are synthesized (e.g., in an automatic DNA synthesizer), purified, annealed, ligated and cloned in appropriate vectors. However, it is not intended that the present invention be limited to any specific method for production of polynucleotides and oligonucleotides, as any suitable method finds use in the present invention.

Accordingly, in some embodiments, a method for preparing the engineered lipase polypeptide can comprise: (a) synthesizing a polynucleotide encoding a polypeptide comprising an amino acid sequence selected from the amino acid sequence of any variant provided in Table 4-1, 4-2, 4-3, 4-4, 4-5, 4-6, 4-7, and/or 5-1, as well as SEQ ID NOS: 2, 94, 350, 442, 540, 646, 758, and/or 868, and (b) expressing the lipase polypeptide encoded by the polynucleotide. In some embodiments of the method, the amino acid sequence encoded by the polynucleotide comprises one or several (e.g., up to 3, 4, 5, or up to 10) amino acid residue deletions, insertions and/or substitutions. In some embodiments, the amino acid sequence comprises 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In some embodiments, the amino acid sequence comprises 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 amino acid residue deletions, insertions and/or substitutions. In some embodiments, the amino acid sequence comprises 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions comprise conservative and/or non-conservative substitutions.

The expressed engineered lipase polypeptide can be assessed for any desired improved property (e.g., activity, selectivity, stability, acid tolerance, protease sensitivity, etc.), using any suitable assay known in the art, including but not limited to the assays and conditions described herein.

In some embodiments, any of the engineered lipase polypeptides expressed in a host cell are recovered from the cells and/or the culture medium using any one or more of the well-known techniques for protein purification, including, among others, lysozyme treatment, sonication, filtration, salting-out, heat treatment, ultra-centrifugation, and chromatography.

Chromatographic techniques for isolation of the lipase polypeptides include, among others, reverse phase chromatography high performance liquid chromatography, ion exchange chromatography, hydrophobic interaction chromatography, gel electrophoresis, and affinity chromatography. Conditions for purifying a particular enzyme depends, in part, on factors such as net charge, hydrophobicity, hydrophilicity, molecular weight, molecular shape, etc., and will be apparent to those having skill in the art. In some embodiments, affinity techniques may be used to isolate the improved variant lipase enzymes. In some embodiments utilizing affinity chromatography purification, any antibody which specifically binds the variant lipase polypeptide finds use.

In some embodiments utilizing affinity chromatography purification, proteins that bind to the glycans covalently attached to lipase find use. In still other embodiments utilizing affinity-chromatography purifications, any small molecule that binds to the lipase active site finds use. For the production of antibodies, various host animals, including but not limited to rabbits, mice, rats, etc., are immunized by injection with a polypeptide (e.g., a lipase variant), or a fragment thereof. In some embodiments, the lipase polypeptide or fragment is attached to a suitable carrier, such as BSA, by means of a side chain functional group or linkers attached to a side chain functional group.

In some embodiments, the engineered lipase polypeptide is produced in a host cell by a method comprising culturing a host cell (e.g., *E. coli, S. cerevisiae, Daucus carota, Nicotiana tabacum, H. sapiens* (e.g., HEK293T), or *Cricetulus griseus* (e.g., CHO)) comprising a polynucleotide sequence encoding an engineered lipase polypeptide as described herein under conditions conducive to the production of the engineered lipase polypeptide and recovering the engineered lipase polypeptide from the cells and/or culture medium.

In some embodiments, the invention encompasses a method of producing an engineered lipase polypeptide comprising culturing a recombinant eukaryotic cell comprising a polynucleotide sequence encoding an engineered lipase polypeptide having at least 80%, 81%, 82%, 83%, 84%, 85%, 86%, 87%, 88%, 89%, 90%, 95%, 96%, 97%, 98%, 99%, or 100% sequence identity to a reference sequence (e.g., SEQ ID NO: 2, 94, 350, 442, 540, 646, 758, and/or 868), and one or more amino acid residue differences as compared to SEQ ID NO: 2, 94, 350, 442, 540, 646, 758, and/or 868, selected from those provided in Tables 4-1, 4-2, 4-3, 4-4, 4-5, 4-6, 4-7, and/or 5-1, and/or combinations thereof when optimally aligned with the amino acid sequence of SEQ ID NO: 2, 94, 350, 442, 540, 646, 758, and/or 868, under suitable culture conditions to allow the production of the engineered lipase polypeptide and optionally recovering the engineered lipase polypeptide from the culture and/or cultured bacterial cells.

In some embodiments, once the engineered polypeptides are recovered from the recombinant host cells or cell culture medium, they are further purified by any suitable method(s) known in the art. In some additional embodiments, the purified lipase polypeptides are combined with other ingredients and compounds to provide compositions and formulations comprising the engineered lipase polypeptide as appropriate for different applications and uses (e.g., pharmaceutical compositions). In some additional embodiments, the purified v polypeptides, or the formulated lipase polypeptides are lyophilized Compositions:

The present invention provides various compositions and formats, including but not limited to those described below. In some embodiments, the present invention provides engineered lipase polypeptides suitable for use in pharmaceutical and other compositions, such as dietary and/or nutritional supplements.

Depending on the mode of administration, these compositions comprising a therapeutically effective amount of an engineered lipase according to the invention are in the form of a solid, semi-solid, or liquid. In some embodiments, the compositions include other pharmaceutically acceptable components such as diluents, buffers, excipients, salts, emulsifiers, preservatives, stabilizers, fillers, and other ingredients. Details on techniques for formulation and administration are well known in the art and described in the literature.

In some embodiments, the engineered lipase polypeptides are formulated for use in pharmaceutical compositions. Any suitable format for use in delivering the engineered lipase polypeptides find use in the present invention, including but not limited to pills, tablets, gel tabs, capsules, lozenges, dragees, powders, soft gels, sol-gels, gels, emulsions, implants, patches, sprays, ointments, liniments, creams, pastes, jellies, paints, aerosols, chewing gums, demulcents, sticks, solutions, suspensions (including but not limited to oil-based suspensions, oil-in water emulsions, etc.), slurries, syrups, controlled release formulations, suppositories, etc. In some embodiments, the engineered lipase polypeptides are provided in a format suitable for injection or infusion (i.e., in an injectable formulation). In some embodiments, the engineered lipase polypeptides are provided in biocompatible matrices such as sol-gels, including silica-based (e.g., oxysilane) sol-gels. In some embodiments, the engineered lipase polypeptides are encapsulated, and/or enterically coated. In some alternative embodiments, the engineered lipase polypeptides are encapsulated in nanostructures (e.g., nanotubes, nanotubules, nanocapsules, or microcapsules, microspheres, liposomes, etc.). Indeed, it is not intended that the present invention be limited to any particular delivery formulation and/or means of delivery. It is intended that the engineered lipase polypeptides be administered by any suitable means known in the art, including but not limited to parenteral, oral, topical, transdermal, intranasal, intraocular, intrathecal, via implants, etc.

In some embodiments, the engineered lipase polypeptides are chemically modified by glycosylation, chemical cross-linking reagents, pegylation (i.e., modified with polyethylene glycol [PEG] or activated PEG, etc.) or other compounds (See e.g., Ikeda, Amino Acids 29:283-287 [2005]; U.S. Pat. Nos. 7,531,341, 7,534,595, 7,560,263, and 7,53,653; US Pat. Appln. Publ. Nos. 2013/0039898, 2012/0177722, etc.). Indeed, it is not intended that the present invention be limited to any particular delivery method and/or mechanism.

In some additional embodiments, the engineered lipase polypeptides are provided in formulations comprising matrix-stabilized enzyme crystals. In some embodiments, the formulation comprises a cross-linked crystalline engineered lipase enzyme and a polymer with a reactive moiety that adheres to the enzyme crystals. The present invention also provides engineered lipase polypeptides in polymers.

In some embodiments, compositions comprising the engineered lipase polypeptides of the present invention include one or more commonly used carrier compounds, including but not limited to sugars (e.g., lactose, sucrose, mannitol, and/or sorbitol), starches (e.g., corn, wheat, rice, potato, or other plant starch), cellulose (e.g., methyl cellulose, hydroxypropylmethyl cellulose, sodium carboxy-methylcellulose), gums (e.g., arabic, tragacanth, guar, etc.), and/or proteins (e.g., gelatin, collagen, etc.).

In some embodiments, the engineered lipase polypeptide is suitable for use to improve dietary fat absorption and in decreasing the dietary lipids in feces. In some embodiments, the present invention provides engineered lipase polypeptides suitable for use in decreasing the concentration of glycolipids in fluids such as blood, cerebrospinal fluid, etc. The dosage of engineered lipase polypeptide(s) administered depends upon the condition or disease, the general condition of the subject, and other factors known to those in the art. In some embodiments, the compositions are intended for single or multiple administrations. In some embodiments, it is contemplated that the concentration of engineered lipase polypeptide(s) in the composition(s) administered to a human with pancreatic insufficiency disease is sufficient to effectively treat, and/or ameliorate disease (e.g., pancreatic insufficiency disease). In some embodiments, the engineered lipase polypeptides find use in combination with other enzymes, such as amylases and/or proteases, for the treatment of diseases such as pancreatic enzyme insufficiency.

In some embodiments, the engineered lipase polypeptides are administered in combination with other pharmaceutical and/or dietary compositions, including but not limited to dietary supplements, nutraceuticals, etc. It is not intended that the present invention be limited to any specific method or form of administration, as any suitable method and/or form finds use.

Experimental

The following Examples, including experiments and results achieved, are provided for illustrative purposes only and are not to be construed as limiting the present invention. In the experimental disclosure below, the following abbreviations apply: ppm (parts per million); M (molar); mM (millimolar), uM and µM (micromolar); nM (nanomolar); mol (moles); gm and g (gram); mg (milligrams); ug and µg (micrograms); L and l (liter); ml and mL (milliliter); cm (centimeters); mm (millimeters); um and µm (micrometers); sec. (seconds); min(s) (minute(s)); h(s) and hr(s) (hour(s)); U (units); MW (molecular weight); rpm (rotations per minute); ° C. (degrees Centigrade); CDS (coding sequence); DNA (deoxyribonucleic acid); RNA (ribonucleic acid); *E. coli* W3110 (commonly used laboratory *E. coli* strain, available from the Coli Genetic Stock Center [CGSC], New Haven, CT); EPI (exocrine pancreatic insufficiency); LIP and lip (lipase); btLIP (*B. thermoamylovorans* lipase); HPLC (high pressure liquid chromatography); ms (mass spectrometry or mass spectroscopy); SDS-PAGE (sodium dodecyl sulfate polyacrylamide gel electrophoresis); PES (polyethersulfone); ACN (acetonitrile); IPA (isopropyl alcohol); IPTG (isopropyl β-D-1-thiogalactopyranoside); PMBS (polymyxin B sulfate); NADPH (nicotinamide adenine dinucleotide phosphate); LB (Luria broth); PBS (phosphate buffered saline); MeOH (methanol); TAG (triolein); DAG (diolein); MAG (monoolein); OA (oleic acid); FIOPC and FIOP (fold improvements over positive control); HTP (high-throughput); CAV (cell accelerator voltage; collision cell accelerator voltage); CE (collision energy); RF (radio frequency); Sinclair (Sinclair Research, and Sinclair Bio Resources, Auxvasse, MO); Sigma-Aldrich (Sigma-Aldrich, St. Louis, MO); Pall Corp. (Pall, Corp., Pt. Washington, NY); Millipore (Millipore, Corp., Billerica MA); Difco (Difco Laboratories, BD Diagnostic Systems, Detroit, MI); Molecular Devices (Molecular Devices, LLC, Sunnyvale, CA); Kuhner (Adolf Kuhner, AG, Basel, Switzerland); Applied Biosystems (Applied Biosystems, part of Life Technologies, Corp., Grand Island, NY), Agilent (Agilent Technologies, Inc., Santa Clara, CA); RAPIDFIRE® MS (RAPIDFIRE® mass spectrometer, Agilent); Thermo Scientific (part of ThermoFisher Scientific, Waltham, MA); Gibco (ThermoFisher Scientific); Pierce (Pierce Biotechnology (now part of Thermo Fisher Scientific), Rockford, IL); ThermoFisher Scientific (Thermo Fisher Scientific, Waltham, MA); Corning (Corning, Inc., Palo Alto, CA); AbbVie (AbbVie, Inc., North Chicago, IL); and Bio-Rad (Bio-Rad Laboratories, Hercules, CA).

Example 1

Bacterial Lipase Gene Acquisition and Construction of Expression Vectors

The DNA sequence encoding *Bacillus thermoamylovorans* lipase (SEQ ID NO: 2) was codon optimized for expression in *E. coli* and cloned into the *E. coli* expression vector pCK110900 vector system (See e.g., U.S. Pat. Nos. 7,629,157, and 9,714,437, and US Pat. Appln. Publn. 2006/0195947, all of which are hereby incorporated by reference herein) or pJV110900 vector system (See e.g., US Pat. Appln Publ. 2017/213758, which is also incorporated by reference herein). However, it is not intended that the present invention be limited to any specific vectors. In addition, in some embodiments, expression vectors lacking antimicrobial resistance markers find use. The plasmid construct was transformed into an *E. coli* strain derived from W3110. Directed evolution techniques generally known by those skilled in the art were used to generate libraries of gene variants from this plasmid construct (See e.g., U.S. Pat. No. 8,383,346, and WO2010/144103), as well as its derivatives.

Example 2

Mammalian Lipase Gene Acquisition, Construction of Expression Vectors and HTP Growth and Activity Screen Genes encoding the mammalian lipases in Table 1 (SEQ ID NOs: 1, 3, 5, 7, 9, and 11) were codon optimized for expression in *Saccharomyces cerevisiae*. A *S. cerevisiae* mating factor alpha (MFα) signal peptide was genetically fused to the mature form of the lipases for secreted expression of the lipases. These yeast strains were grown in HTP as described in WO 2016/105889 (herein incorporated by reference). The supernatant from these yeast cultures were assayed for activity as described in Example 3. The activity obtained from these lipases are shown in Table 2-1.

TABLE 2-1

Characterization of Wild Type Lipase Enzyme Activities

| SEQ ID NO: (nt/aa) | Lipase | TAG assay[1] |
|---|---|---|
| 1/2 | *Bacillus thermoamylovorans* | ++++ |
| 3/4 | Pancreatic triacylglycerol lipase from *Homo sapiens* | ++ |
| 5/6 | Pancreatic triacylgycerol lipase from *Panthera tigris altaica* | ++ |
| 7/8 | Pancreatic lipase-related protein 2 from *Homo sapiens* | ++ |
| 9/10 | Gastric lipase from *Canis lupus familiaris* | + |
| 11/12 | Gastric lipase from *Leptonychotes weddellii* | + |

[1]Activity levels were defined as follows: "+" > 1%; "++" > 2.5%; "+++" > 5%; and "++++" > 10% conversion of triolein to oleic acid in 1 hour.

Example 3

High-Throughput (HTP) Growth of Lipase Variants and Screening Conditions

Experiments conducted on the growth and screening of lipase variants are described below.
High-Throughput (HTP) Growth of *B. thermoamylovorans* Lipase (btLIP) and Lipase (LIP) Variants:
Transformed *E. coli* cells were selected by plating onto LB agar plates containing 1% glucose with selection. After overnight incubation at 37° C., colonies were placed into the wells of 96-well shallow flat bottom plates (NUNC™, Thermo-Scientific) filled with 180 µl/well LB supplemented with 1% glucose and selection. The cultures were allowed to grow overnight for 18-20 hours in a shaker incubator (200 rpm, 30° C., and 85% relative humidity; Kuhner). Overnight growth samples (20 µL) were transferred into COSTAR® 96-well deep plates filled with 380 µL of Terrific Broth supplemented with a selection compound (e.g., chloramphenicol). The plates were incubated for 135 minutes in a shaker incubator (250 rpm, 30° C., and 85% relative humidity; Kuhner). The expression of the lipase variants was then induced with 40 µL of 10 mM IPTG in sterile water and the cultures incubated overnight for 20-24 hours in a shaker incubator (250 rpm, 30° C., and 85% relative humidity; Kuhner). The cells were pelleted by centrifugation (4000 rpm×20 min), the supernatants were discarded, and the cells were frozen at −80° C. prior to analysis.
Lysis of HTP Pellets:
First, 200-400 µL of lysis buffer (1×PBS, 1 mg/ml lysozyme, and 0.5 mg/ml polymyxin B sulfate) were added to the cell pellets. The cell pellet and buffer were gently shaken for 1.5-2 h at room temperature, and centrifuged (4000 rpm×5 min) prior to use of the clarified lysates in the various HTP assays described herein. Analysis of these lysates by SDS-PAGE revealed the presence of an overexpressed protein at an apparent MW of ~45 kDa, consistent with the expected MW of btLIP.
Analysis of Clarified Lysates for Lipase Activity:
The btLIP variant activity was determined by measuring the formation of oleic acid, diolein, and monoolein, by their change in abundance over time. For this assay, 90 µL of 100 mM sodium phosphate and 2.5 µL triolein pH 7.0, were mixed with 10 µL of lysate and added to the wells of a poly-acrylate 96-well microtiter plate (COSTAR® plate #3635, Corning) and incubated at 37° C. for 30 min to 1 hr. Reactions were quenched with 600 µL ACN:IPA (1:3), clarified with centrifugation and separated on a C18 POROSHELL® 5 µm 150 mm column run with an isocratic flow of 55% IPA in acetonitrile to detect oleic acid, diolein, monoolein, and triolein at 214 nm. Alternatively, quenched reactions were clarified and diluted 10 µL into 190 µL 50:50 IPA:MeOH, shaken for 1 min, then diluted once again by adding 10 µL into 190 µL of 50:25:25 $H_2O$:IPA:MeOH. Samples were then analyzed by RAPIDFIRE® MS. In the following Examples, "unchallenged activity" refers to the lipase activity determinations conducted without any external pretreatment/challenges as described in the following assay method descriptions.

TABLE 3-1

Agilent RAPIDFIRE ® Conditions

| | |
|---|---|
| Pump1 Buffer | MS grade water; 1.5 mL/min flow rate |
| Pump2 Buffer | MS grade methanol with 0.1% formic acid and 0.05 mM ammonium acetate; 1.25 mL/min flow rate |
| Pump3 Buffer | MS grade methanol with 0.1% formic acid and 0.05 mM ammonium acetate; 0.8 mL/min flow rate |
| Aqueous wash | Water |
| Organic wash | Acetonitrile |
| SPE cartridge | 1783C4 |
| RF state 1 Aspirate | 600 ms |
| RF state 2 Load/Wash | 2000 ms |
| RF state 3 Extra Wash | 0 |
| RF state 4 Elute | 5000 ms |
| RF state 5 Reequilibrate | 500 ms |
| Agilent Jet Stream Source Parameters | |
| Drying gas temperature | 300° C. |
| Drying gas flow | 10 L/min |
| Nebulizer pressure | 45 psi |
| Sheath gas temperature | 350° C. |

TABLE 3-1-continued

Agilent RAPIDFIRE® Conditions

| Sheath gas flow | 11 L/min |
|---|---|
| Capillary voltage | 3500/−2500 V |
| Nozzle voltage | 2000/−2000 V |

Agilent 6470 Triple Quadrupole MRM Parameters

| Compound | Q1 | Q3 | Dwell | Fragmentor | CE | CAV |
|---|---|---|---|---|---|---|
| Positive Mode Method | | | | | | |
| DAG | 643.6 | 361.4 | 50 | 105 | 30 | 2 |
| DAG | 643.6 | 339.4 | 50 | 105 | 33 | 2 |
| DAG | 643.6 | 305.2 | 50 | 105 | 28 | 2 |
| MAG | 379.3 | 379.3 | 50 | 105 | 0 | 4 |
| MAG | 379.3 | 119 | 50 | 105 | 11 | 4 |
| TAG | 902.7 | 339.4 | 50 | 105 | 33 | 6 |
| TAG | 902.7 | 265.3 | 50 | 105 | 40 | 6 |
| TAG | 902.7 | 603.4 | 50 | 105 | 24 | 6 |
| Negative Mode Method | | | | | | |
| OA | 281.3 | 281.3 | 50 | −150 | 0 | −5 |
| OA | 281.3 | 263.2 | 50 | −150 | −20 | −5 |

HTP Analysis of Clarified Lysates Pretreated with Heat Pre-Treatment:

The activities of btLIP variants were determined after incubation at 37° C. to 65° C. First, 100 μL of clarified lysate were added to the wells of a 96-well BioRad Hard-Shell PCR thin wall microtiter plate (#hsp9601; BioRad). The plates were sealed and incubated at 37° C. to 65° C. in a thermocycler for 1 h prior to analysis. Variant activity was determined by measuring the formation of oleic acid, diolein, and monoolein, by their change in abundance over time. For this assay, 90 μL of 100 mM sodium phosphate and 2.5 μL triolein pH 7.0, were mixed with 10 μL of lysate and added to the wells of a poly-acrylate 96-well microtiter plate (COSTAR® plate #3635; Corning), and incubated at 37° C. for 30 min to 1 hr. Reactions were quenched with 600 μL ACN:IPA (1:3), clarified and diluted 10 μL into 190 μL 50:50 IPA:MeOH, shaken for 1 min, then diluted once again by adding 10 μL into 190 μL of 50:25:25 $H_2O$:IPA:MeOH. Samples were then analyzed by RAPIDFIRE® MS. The results are provided in the Tables in Example 4.

HTP Analysis of Clarified Lysates with a Low pH and with or Without Pepsin Pre-Treatment:

The activities of btLIP variants were determined after incubation with pepsin to simulate the environment of the stomach. First, 90 μL of 100 mM sodium citrate, 2.5 mg TAG pH 2.0 to 5.0 with or without 1.5 mg/mL pepsin (P7000 Sigma), and 10 μL of clarified lysate were added to the wells of a 96-well round bottom microtiter plate (COSTAR® plate #3798; Corning). The plates were sealed and incubated at 37° C. with shaking (THERMOTRON® shaker HT Infors AJ185, 400 rpm, 1" throw) for 1 h prior to analysis. Variant activity was determined by measuring the formation of oleic acid, diolein, and monoolein, by their change in abundance over time. For this assay, 90 μL of 100 mM sodium phosphate and 2.5 μL triolein pH 7.0, were mixed with 10 μL of the pepsin reaction mixture and added to the wells of a poly-acrylate 96-well microtiter plate (COSTAR® plate #3635; Corning), and incubated at 37° C. for 30 min to 1 hr. Reactions were quenched with 600 μL ACN:IPA (1:3), clarified and diluted 10 μL into 190 μL 50:50 IPA:MeOH, shaken for 1 min, then diluted once again by adding 10 μL into 190 μL of 50:25:25 $H_2O$:IPA:MeOH. Samples were then analyzed by RAPIDFIRE® MS. The results are provided in the Tables in Example 4.

HTP Analysis of Clarified Lysates with Protease Pre-Treatment:

The activities of btLIP variants were determined after incubation with chymotrypsin and trypsin, to simulate the environment of the lower intestine. First, 50 μL of protease mix (0.01-100 mg/ml chymotrypsin (C4129, Sigma), 0.01-100 mg/ml trypsin (T7409, Sigma), 0-30 μL of 20 mM sodium taurocholate in 100 mM sodium phosphate pH 6.5 to 7.0, and 50 μL of clarified lysate were added to the wells of a 96-well round bottom microtiter plate (COSTAR® plate #3798; Corning). The plates were sealed and incubated at 37° C. with shaking (THERMOTRON® shaker HT Infors AJ185, 400 rpm, 1" throw) for 1 h prior to analysis. Variant activity was determined by measuring the formation of oleic acid, diolein, and monoolein, by their change in abundance over time. For this assay, 90 μL of 100 mM sodium phosphate and 2.5 μL triolein pH 7.0, were mixed with 10 μL of the protease reaction mixture, and added to the wells of a poly-acrylate 96-well microtiter plate (COSTAR® plate #3635; Corning) and incubated at 37° C. for 30 min to 1 hr. Reactions were quenched with 600 μL ACN:IPA (1:3), clarified and diluted 10 μL into 190 μL 50:50 IPA:MeOH, shaken for 1 min, then diluted once again by adding 10 μL into 190 μL of 50:25:25 $H_2O$:IPA:MeOH. Samples were then analyzed by RAPIDFIRE® MS. The results are provided in the Tables in Example 4.

HTP Analysis of Clarified Lysates with Multistep Gastrointestinal (GI) Challenge:

The activities of btLIP variants were determined after incubation at 37° C. to 65° C. First, 100 μL of clarified lysate were added to the wells of a 96-well BioRad Hard-Shell PCR thin wall microtiter plate (#hsp9601; BioRad). The plates were sealed and incubated at 37° C. to 65° C. in a thermocycler for 1 h prior to gastric challenge. Next, btLIP variants were incubated with pepsin, to simulate the environment of the stomach. First, 50 μL of 100 mM sodium citrate pH 2.0 to 5.0, with 3.0 mg/mL Pepsin (P7000 Sigma), and 50 μL of heat-treated lysate were added to the wells of a 96-well round bottom microtiter plate (COSTAR® plate #3798; Corning). The plates were sealed and incubated at 37° C. with shaking (THERMOTRON® shaker HT Infors AJ185, 400 rpm, 1" throw) for 1 h prior to analysis. Next, btLIP variants were incubated with chymotrypsin and trypsin, to simulate the environment of the lower intestine. In this step, 100 μL of protease mix (0.01-100 mg/ml chymotrypsin [C4129; Sigma], and 0.01-100 mg/ml trypsin [T7409; Sigma]), 0-30 μL of 20 mM sodium taurocholate in 100 mM sodium phosphate pH 6.5 to 7.0, and 100 μL of heat treated gastric challenged lysate were added to the wells of a 96-well round bottom microtiter plate (COSTAR® plate #3798; Corning). The plates were sealed and incubated at 37° C. with shaking (THERMOTRON® shaker HT Infors AJ185, 400 rpm, 1" throw) for 1 h prior to analysis. Variant activity was determined by measuring the formation of oleic acid, diolein, and monoolein, by their change in abundance over time. For this assay, 90 μL of 100 mM sodium phosphate and 2.5 μL triolein pH 7.0 were mixed with 10 μL of gastrointestinal reaction and added to the wells of a polyacrylate 96-well microtiter plate (COSTAR® plate #3635; Corning) and incubated at 37° C. for 30 min to 1 hr. Reactions were quenched with 600 μL ACN:IPA (1:3), clarified and diluted 10 μL into 190 μL 50:50 IPA:MeOH, shaken for 1 min, then diluted once again by adding 10 μL into 190 μL of 50:25:25 H₂O:IPA:MeOH. Samples were then analyzed by RAPIDFIRE® MS. The results are provided in the Tables in Example 4.

Example 4

Screening Results for Lipase Variants

The variants generated from homologs diversity and saturation mutagenesis were screened under several different conditions as described in Example 3. The results (relative to SEQ ID NO: 2) are provided in Table 4-1. In this Table, the amino acid differences are indicated relative to SEQ ID NO: 2.

TABLE 4-1

Triacylglycerol Lipase Activity (Relative to SEQ ID NO: 2)[1]

| SEQ ID NO: (nt/aa) | Amino Acid Differences | FIOP Unchallenged Activity | FIOP 50° C.[2] | FIOP Protease[3] | FIOP pH 3[4] | FIOP Taurocholate[5] |
|---|---|---|---|---|---|---|
| 13/14 | E174R | ++ | ++ | + | ++ | ++ |
| 15/16 | I96E | ++ | + | | + | ++ |
| 17/18 | Y27V/R46T/F385P | ++ | ++++ | ++ | ++ | ++ |
| 19/20 | Y27V/K70N/Y136V/Q231E/F385P | ++ | ++++ | +++ | +++ | ++ |
| 21/22 | A219C | ++ | ++ | + | + | ++ |
| 23/24 | Y27V/Y136V/K323I/F385P | ++ | ++++ | +++ | ++ | ++ |
| 25/26 | Q175G | | ++ | | + | ++ |
| 27/28 | P146A | ++ | + | ++ | + | ++ |
| 29/30 | F385C | ++ | + | ++ | ++ | ++ |
| 31/32 | H218I | ++ | ++ | +++ | ++ | ++ |
| 33/34 | Q231E/F385P | ++ | ++++ | +++ | ++ | ++ |
| 35/36 | Y48V | | + | + | | ++ |
| 37/38 | E174H | + | ++ | + | ++ | ++ |
| 39/40 | K82C | ++ | + | ++ | ++ | ++ |
| 41/42 | S216T | + | + | + | ++ | ++ |
| 43/44 | A219R | ++ | + | + | | ++ |
| 45/46 | Y27V/T149E | + | +++ | ++ | ++ | ++ |
| 47/48 | G22N | + | ++ | + | + | ++ |
| 49/50 | G151A | + | + | | + | ++ |
| 51/52 | G281K | + | ++ | + | | ++ |
| 53/54 | S189W | | ++ | | ++ | ++ |
| 55/56 | E2H | + | + | + | ++ | ++ |
| 57/58 | A219K | ++ | + | + | ++ | ++ |
| 59/60 | F385T | ++ | ++ | ++ | ++ | ++ |
| 61/62 | P94S | ++ | ++ | ++ | | ++ |
| 63/64 | G281R | ++ | ++ | + | | ++ |
| 65/66 | Y27V/T149E/F385P | ++ | ++++ | +++ | +++ | ++ |
| 67/68 | T73I | + | + | + | ++ | ++ |
| 69/70 | Q212C | + | + | + | + | ++ |
| 71/72 | S189A | + | ++ | ++ | ++ | + |
| 73/74 | Q300A | ++ | | | ++ | + |
| 75/76 | Q300D | ++ | ++ | ++ | ++ | + |
| 77/78 | F38A | | + | + | | + |
| 79/80 | G151L | + | + | | + | + |
| 81/82 | H218M | ++ | ++ | ++ | ++ | + |
| 83/84 | F385R | ++ | ++ | + | ++ | + |
| 85/86 | S296R | + | ++ | ++ | ++ | + |
| 87/88 | P146F | ++ | ++ | + | ++ | + |
| 89/90 | E142L | + | + | + | + | + |
| 91/92 | F89A | | + | + | | + |
| 93/94 | F385P | ++ | +++ | ++ | ++ | + |
| 95/96 | S216R | + | ++ | | | + |
| 97/98 | R46T/T149E/F183L/Q231E/F385P | ++ | ++++ | +++ | +++ | + |
| 99/100 | Q212G | + | ++ | + | + | + |
| 101/102 | T226R | + | + | | | + |
| 103/104 | T3S | ++ | ++ | ++ | ++ | + |
| 105/106 | T3R | + | ++ | ++ | ++ | + |
| 107/108 | E142I | + | + | + | ++ | + |
| 109/110 | T149R | + | ++ | + | ++ | + |
| 111/112 | P146S | + | ++ | + | | + |
| 113/114 | K82L | + | ++ | ++ | ++ | + |
| 115/116 | T73C/V305I | + | + | + | | + |
| 117/118 | S4W | ++ | ++ | ++ | ++ | + |
| 119/120 | F89T | + | ++ | + | + | + |
| 121/122 | Y135S | | + | + | + | + |

TABLE 4-1-continued

Triacylglycerol Lipase Activity (Relative to SEQ ID NO: 2)[1]

| SEQ ID NO: (nt/aa) | Amino Acid Differences | FIOP Unchallenged Activity | FIOP 50° C.[2] | FIOP Protease[3] | FIOP pH 3[4] | FIOP Taurocholate[5] |
|---|---|---|---|---|---|---|
| 123/124 | G85I | + | + | + | | + |
| 125/126 | K82E/P94S/I199L | + | +++ | ++ | ++ | + |
| 127/128 | Q195D/Q231E/F385P | ++ | ++++ | +++ | ++ | + |
| 129/130 | E141S | + | + | + | | + |
| 131/132 | K82E | ++ | + | | ++ | + |
| 133/134 | Y135V | | + | + | | + |
| 135/136 | M292V | + | + | + | ++ | + |
| 137/138 | T3A | + | ++ | + | ++ | + |
| 139/140 | I96S | ++ | ++ | ++ | | + |
| 141/142 | Q175R | + | ++ | ++ | | + |
| 143/144 | T149E/Q231E/F385P | ++ | ++++ | +++ | ++ | + |
| 145/146 | E141F | | + | + | | + |
| 147/148 | M292L | ++ | + | ++ | +++ | + |
| 149/150 | K70N | + | +++ | ++ | ++ | + |
| 151/152 | K82F | + | | + | | + |
| 153/154 | P140T | + | ++ | + | | + |
| 155/156 | S178R | ++ | | | | + |
| 157/158 | A87R | | + | | + | + |
| 159/160 | I199L | + | +++ | ++ | ++ | + |
| 161/162 | I96N | + | + | + | | + |
| 163/164 | G151I | + | + | | + | + |
| 165/166 | Q212T | | + | | + | + |
| 167/168 | T73R | + | + | + | | + |
| 169/170 | E142F | | ++ | + | | + |
| 171/172 | N330Y | + | | + | | + |
| 173/174 | G85W | + | + | + | | + |
| 175/176 | H218G | | + | ++ | | + |
| 177/178 | Y135Q | | + | + | | + |
| 179/180 | Q250T | + | ++ | + | | + |
| 181/182 | F38L | ++ | + | + | + | + |
| 183/184 | P213H | | ++ | ++ | | + |
| 185/186 | H218T | + | ++ | ++ | + | + |
| 187/188 | F183L/F385P | | ++++ | +++ | + | + |
| 189/190 | P146Y | | + | ++ | + | + |
| 191/192 | F89W | + | ++ | + | | + |
| 193/194 | F89V | + | ++ | + | | + |
| 195/196 | E2M | | + | + | + | + |
| 197/198 | K181H | | ++ | | | + |
| 199/200 | T3G | + | ++ | + | + | + |
| 201/202 | F385D | ++ | ++ | ++ | ++ | + |
| 203/204 | Y27V/F385P | ++ | ++++ | +++ | ++ | + |
| 205/206 | E83G | | + | + | | + |
| 207/208 | P213A/N330T | | +++ | ++ | | + |
| 209/210 | I144M | + | + | + | ++ | + |
| 211/212 | E141A | + | ++ | + | | + |
| 213/214 | Y27V/R46T/Y97A/Y136V/T149E/F385P | ++ | ++++ | ++ | ++ | + |
| 215/216 | M292A | + | | + | + | + |
| 217/218 | E141L | | + | + | | + |
| 219/220 | T149K | + | ++ | + | ++ | + |
| 221/222 | E83K | ++ | + | | | + |
| 223/224 | K82G | ++ | + | | ++ | + |
| 225/226 | A219G | + | ++ | + | | + |
| 227/228 | I144W | + | ++ | + | | + |
| 229/230 | I144R | + | + | + | | + |
| 231/232 | G44E | | + | | | + |
| 233/234 | Y97A/T149E/F385P | + | ++++ | ++ | + | + |
| 235/236 | E142A | | + | | | + |
| 237/238 | M292C | + | | | | + |
| 239/240 | S296M | | ++ | | | + |
| 241/242 | Q300T | + | ++ | + | + | + |
| 243/244 | S216W | | ++ | | | + |
| 245/246 | T149E | + | +++ | ++ | ++ | + |
| 247/248 | S4Y | + | ++ | ++ | ++ | + |
| 249/250 | Y135G | + | + | + | | + |
| 251/252 | Y136V/F385P | + | ++++ | +++ | + | + |
| 253/254 | K210V | | + | | | + |
| 255/256 | N379T | | + | + | | + |
| 257/258 | S178T | | ++ | + | + | + |
| 259/260 | Q212R | + | ++ | + | + | + |
| 261/262 | T92A | + | + | + | + | + |
| 263/264 | Y135T | | + | + | | + |
| 265/266 | Q195V | | + | ++ | | + |
| 267/268 | I199L/P213A | + | ++++ | ++ | + | + |

TABLE 4-1-continued

Triacylglycerol Lipase Activity (Relative to SEQ ID NO: 2)[1]

| SEQ ID NO: (nt/aa) | Amino Acid Differences | FIOP Unchallenged Activity | FIOP 50° C.[2] | FIOP Protease[3] | FIOP pH 3[4] | FIOP Taurocholate[5] |
|---|---|---|---|---|---|---|
| 269/270 | F38H | | + | | + | |
| 271/272 | F385A | ++ | + | ++ | ++ | |
| 273/274 | E2T | ++ | + | + | + | |
| 275/276 | E247R | | ++ | + | | |
| 277/278 | R46T/K70N | + | +++ | ++ | + | |
| 279/280 | K194N | + | +++ | +++ | ++ | |
| 281/282 | K194T | + | | ++ | ++ | |
| 283/284 | Q175L | + | +++ | ++ | ++ | |
| 285/286 | S4M | | + | + | ++ | |
| 287/288 | R308A | | + | + | ++ | |
| 289/290 | K338N | | + | | | |
| 291/292 | K194N/I199L | | +++ | +++ | ++ | |
| 293/294 | H218D | | + | + | + | |
| 295/296 | Y238S | | ++ | | | |
| 297/298 | K82E/P94S/D101S/ K194N/I199L | + | +++ | +++ | ++ | |
| 299/300 | N41V | | ++ | | | |
| 301/302 | R270V | | + | | | |
| 303/304 | K210A | ++ | + | + | + | |
| 305/306 | K34D | ++ | | | +++ | |
| 307/308 | T274D | | | | +++ | |
| 309/310 | S189E | | + | ++ | ++ | |

[1]Levels of increased activity were determined relative to the reference polypeptide of SEQ ID NO: 2, and defined as follows: "+" > 0.9; "++" > 1.1; "+++" > 2; and "++++" > 5.
In addition, the results shown in the above columns are for the experimental conditions described as follows:
[2]FIOP results after 50° C. heat pre-treatment;
[3]FIOP results after protease pre-treatment;
[4]FIOP results after pH 3 pre-treatment; and
[5]FIOP results after taurocholate pre-treatment.

Based on the results shown in Table 4-1, SEQ ID NO: 94 was chosen as the parent sequence for the next iteration of protein optimization. Beneficial mutations identified from the results shown in Table 4-1 were recombined into the backbone. The variants were screened under the same conditions as described in Example 3. The only difference is that the acid challenge screen was performed at pH 3.5 instead of pH 3. The data relative to SEQ ID NO: 94 are listed in Table 4-2. In this Table, the amino acid differences are indicated relative to SEQ ID NO: 94.

TABLE 4-2

Triacylglycerol Lipase Activity (Relative to SEQ ID NO: 94)[1]

| SEQ ID NO: (nt/aa) | Amino Acid Differences | FIOP Unchallenged Activity | FIOP 50° C.[2] | FIOP Protease[3] | FIOP pH 3.5[4] | FIOP Taurocholate[5] |
|---|---|---|---|---|---|---|
| 311/312 | S4W/V11A/T149E/ M292L/S296R/Q300D | + | ++ | + | ++ | ++ |
| 313/314 | M292L/S296R/Q300D | ++ | ++ | ++ | ++ | ++ |
| 315/316 | T3S/S4W/I96E/S296R/ Q300D | ++ | + | ++ | ++ | + |
| 317/318 | T149E/Q231E/M292L/ S296R/Q300D | + | +++ | ++ | ++ | ++ |
| 319/320 | S4W/I96E/T149E/ Q231E/S296R/Q300D | ++ | ++ | ++ | ++ | ++ |
| 321/322 | E174R/Q231E | + | ++ | ++ | ++ | + |
| 323/324 | T149E/A219K/Q231E/ M292L/S296R/ Q300D | ++ | +++ | ++ | ++ | ++ |
| 325/326 | Q231E/M292L/S296R/ Q300D | + | +++ | ++ | ++ | ++ |
| 327/328 | T149E/S296R/Q300D | + | ++ | ++ | ++ | ++ |
| 329/330 | S4W/I96E/T149E/ M292L/S296R/Q300D | ++ | +++ | ++ | ++ | ++ |
| 331/332 | T149E/E174H/M292L/ S296R | ++ | +++ | ++ | ++ | ++ |
| 333/334 | S4W/I96E/M292L/ S296R/Q300D | ++ | ++ | ++ | ++ | + |
| 335/336 | S4W/E174H/A219K/ M292L/S296R | ++ | +++ | ++ | ++ | ++ |
| 337/338 | I96E/T149E/M292L/ S296R | + | + | ++ | ++ | + |

TABLE 4-2-continued

Triacylglycerol Lipase Activity (Relative to SEQ ID NO: 94)[1]

| SEQ ID NO: (nt/aa) | Amino Acid Differences | FIOP Unchallenged Activity | FIOP 50° C.[2] | FIOP Protease[3] | FIOP pH 3.5[4] | FIOP Taurocholate[5] |
|---|---|---|---|---|---|---|
| 339/340 | I96E/E174H/A219K/Q231E/M292L/S296R | + | ++ | ++ | ++ | ++ |
| 341/342 | S4W/Q231E/S296R/Q300D | ++ | ++ | ++ | ++ | ++ |
| 343/344 | I96E/T149E/Q231E/M292L/S296R | ++ | ++ | ++ | + | ++ |
| 345/346 | Q231E/M292L/S296R | ++ | ++ | ++ | ++ | ++ |
| 347/348 | M292L/S296R | ++ | ++ | ++ | ++ | ++ |
| 349/350 | T149E/Q231E/M292L/S296R | ++ | +++ | ++ | ++ | ++ |
| 351/352 | I96E/T149E/E174H/M292L/S296R | + | +++ | ++ | ++ | ++ |
| 353/354 | E174H/S296R | ++ | ++ | ++ | ++ | ++ |
| 355/356 | S296R/Q300D | ++ | ++ | + | ++ | ++ |
| 357/358 | I96E/Q231E/S296R | + | ++ | | ++ | ++ |
| 359/360 | T149E/S296R | ++ | ++ | + | ++ | + |
| 361/362 | Q231E | ++ | + | | + | ++ |
| 363/364 | Q231E/S296R | + | + | + | ++ | + |
| 365/366 | Q231E/Q300D | + | ++ | ++ | ++ | + |
| 367/368 | S4W/T149E/E174R | ++ | ++ | + | | ++ |
| 369/370 | S4W/I96E/Q231E/S296R/Q300D | ++ | + | ++ | ++ | + |
| 371/372 | T3S/M292L/S296R | + | ++ | ++ | ++ | + |
| 373/374 | Y27V | + | ++ | | + | + |
| 375/376 | S296R | + | ++ | | | ++ |
| 377/378 | S4W | ++ | ++ | | | ++ |
| 379/380 | S4W/I96E/A219K/S296R | ++ | ++ | | + | ++ |
| 381/382 | T149E/E174H/Q300D | ++ | + | ++ | +++ | + |
| 383/384 | T73I/K82C | ++ | + | | + | ++ |
| 385/386 | T73I/K82L/F183L | + | + | + | ++ | + |
| 387/388 | Y27V/K34D/K82E | + | + | | ++ | |
| 389/390 | Y27V/T73I/K82L/H218I | + | + | | | ++ |
| 391/392 | K34D/K82C | + | + | + | ++ | ++ |
| 393/394 | Y27V/H218I | + | ++ | | + | + |
| 395/396 | Y27V/F89T/S178P | | ++ | | ++ | ++ |
| 397/398 | Y27V/T73I/K82L/H218M | + | ++ | | | ++ |
| 399/400 | Y27V/F89T | + | + | + | ++ | |
| 401/402 | P94S/P146F/Q175G | + | + | ++ | ++ | ++ |
| 403/404 | Y27V/F89T/H218I | ++ | ++ | | | + |
| 405/406 | H218I | + | | ++ | ++ | + |
| 407/408 | K34D/H218M | + | + | | ++ | |
| 409/410 | K34D/T73I/H218I | + | + | | ++ | |
| 411/412 | P146F/Q175G/S189A/G281K | + | | + | ++ | + |

[1]Levels of increased activity were determined relative to the reference polypeptide of SEQ ID NO: 94 and defined as follows: "+" > 0.9, "++" > 1.1, "+++" > 2, "++++" > 5.
In addition, the results shown in the above columns are for the experimental conditions described as follows:
[2]FIOP results after 50° C. heat pre-treatment;
[3]FIOP results after protease pre-treatment;
[4]FIOP results after pH 3.5 pre-treatment; and
[5]FIOP results after taurocholate pre-treatment.

Based on the results shown in Table 4-2, SEQ ID NO: 350 was chosen as the next parent sequence for the next iteration of protein optimization. Beneficial mutations identified from Table 4-2 were recombined into the backbone. Additionally, variants were also constructed using SEQ ID NO: 350, through saturation mutagenesis at different positions. The variants were assayed as described in Example 3, and the results are provided in Table 4-3. In this Table, the amino acid differences are indicated relative to SEQ ID NO: 350.

TABLE 4-3

Triacylglycerol Lipase Activity (Relative to SEQ ID NO: 350)[1]

| SEQ ID NO: (nt/aa) | Amino Acid Differences (Relative to SEQ ID NO: 350) | FIOP After Multistep Heat and GI Challenge Screen |
|---|---|---|
| 413/414 | S4W/A303P | ++++ |
| 415/416 | S4W/G271D | ++++ |
| 417/418 | A303P | ++++ |
| 419/420 | Q99D | ++++ |
| 421/422 | L33Y | +++ |
| 423/424 | S4W/K70H | +++ |
| 425/426 | S4W/L243R | +++ |
| 427/428 | Q339K | +++ |
| 429/430 | E134R | +++ |
| 431/432 | S4W | +++ |
| 433/434 | F368T | +++ |
| 435/436 | N233W | +++ |
| 437/438 | L243R | +++ |
| 439/440 | E174H/Q175L/S189A | ++ |
| 441/442 | Q175L/S189A/Y373F | ++ |
| 443/444 | Y27V/K82C/E174H/Q175G/S189A/H218M/Q300D/S369N/Y373F | ++ |
| 445/446 | S4W/Q175G/H218M/Y373F | ++ |
| 447/448 | F368A | ++ |
| 449/450 | Q175G/S189A/H218M/Q300D/Y373F | ++ |
| 451/452 | Q175G/H218M | ++ |
| 453/454 | N153G | ++ |
| 455/456 | Y27V/K82C/E174H/Q175G/H218M/Q300D/S369N | ++ |
| 457/458 | E231Q | ++ |
| 459/460 | E174H/Y373F | ++ |
| 461/462 | S4W/Q175G/S189A/H218M | ++ |
| 463/464 | N104H | ++ |
| 465/466 | S4W/D334T | ++ |
| 467/468 | Q293R | ++ |
| 469/470 | S331R | ++ |
| 471/472 | S4W/N375A | ++ |
| 473/474 | S4W/Q175G/H218M/V224A | ++ |
| 475/476 | A336R | ++ |
| 477/478 | S4W/Q175G/S189A/Q300D | ++ |
| 479/480 | L25V | ++ |
| 481/482 | Q175G/H218M/H382M | ++ |
| 483/484 | A191L | ++ |
| 485/486 | Y27V/K82C/E174H/Q175G/H218M/Q300D/Y373F/H382M | ++ |
| 487/488 | E102L | ++ |
| 489/490 | N233S | ++ |
| 491/492 | S4W/E102T | ++ |
| 493/494 | S4W/I185L | ++ |
| 495/496 | S4W/N233R | ++ |
| 497/498 | Y27V/K82C/E174H/H218M/Q300D/Y373F | ++ |
| 499/500 | N233G | ++ |
| 501/502 | Y373F | ++ |
| 503/504 | S4W/S189A/H218M/Y373F | ++ |
| 505/506 | Q193L | ++ |
| 507/508 | S4W/A336T | ++ |
| 509/510 | S4W/Q193T | ++ |
| 511/512 | R28N | ++ |
| 513/514 | S4W/A336S | ++ |
| 515/516 | S4W/S137R | ++ |
| 517/518 | S4W/P228E | + |
| 519/520 | S4W/Y27V/S189A/Q300D | + |
| 521/522 | S4W/H218M/Q300D/S369N/Y373F | + |
| 523/524 | S189A/H218M/Q300D/Y373F | + |
| 525/526 | Y27V/S189A/H218M/Y373F | + |

[1]Levels of increased activity were determined relative to the reference polypeptide of SEQ ID NO: 350, and defined as follows: "+" > 0.9; "++" > 1.1; "+++" > 2; and "++++" > 5.

Based on the results from Table 4-3, SEQ ID NO: 442 was chosen as the next parent sequence for the next iteration of protein optimization. Beneficial mutations identified based on the results shown in Table 4-3 were recombined into the backbone. Additionally, variants were also constructed on SEQ ID NO: 442, through saturation mutagenesis at different positions. The variants were assayed as described in Example 3, and the results are provided in Table 4-4. In this Table, the amino acid differences are indicated relative to SEQ ID NO: 442.

TABLE 4-4

Triacylglycerol Lipase Activity (Relative to SEQ ID NO: 442)[1]

| SEQ ID NO: (nt/aa) | Amino Acid Differences (Relative to SEQ ID NO: 442) | FIOP After Multistep Heat and GI Challenge Screen with Taurocholate | FIOP After Multistep Heat and GI Challenge Screen without Taurocholate |
|---|---|---|---|
| 527/528 | E174H/Q193L/A303P/N375A | +++ | +++ |
| 529/530 | L33Y/E174H/Q193L/L243R | +++ | +++ |
| 531/532 | L33Y/L175G/H218M/A303P | +++ | ++ |
| 533/534 | G281P | ++ | ++ |
| 535/536 | E174H/Q193L/N375A | +++ | ++ |
| 537/538 | Q195L | +++ | ++ |
| 539/540 | K70H/G271D/Q293R/D334T | +++ | ++ |
| 541/542 | Q195I | +++ | ++ |
| 543/544 | E174H/L175G/Q193L | ++ | ++ |
| 545/546 | E174H/H218M/N233R/G271D/Q293R/A303P | +++ | ++ |
| 547/548 | Q195Y | ++ | ++ |
| 549/550 | E174H/L175G/H218M/Q339K | +++ | ++ |
| 551/552 | T274D | ++ | ++ |
| 553/554 | M225L | ++ | ++ |
| 555/556 | H218M/A303P | +++ | ++ |
| 557/558 | F38A | ++ | ++ |
| 559/560 | F38G | +++ | ++ |
| 561/562 | N330F | ++ | ++ |
| 563/564 | N330H | ++ | ++ |
| 565/566 | E174R | ++ | ++ |
| 567/568 | Q193L/G271D/A303P/D334T | ++ | ++ |
| 569/570 | I199H | | ++ |
| 571/572 | Y238W | ++ | ++ |
| 573/574 | H218M/L243R | +++ | ++ |
| 575/576 | L33Y | ++ | ++ |
| 577/578 | H218M/L243R/A303P/D334T | +++ | ++ |
| 579/580 | H218D | ++ | ++ |
| 581/582 | L175G/Q193L/H218M/N233R/L243R/N375A | ++ | ++ |
| 583/584 | G281K | ++ | ++ |
| 585/586 | K181Q | ++ | ++ |
| 587/588 | Q193L/H218M/L243R | +++ | ++ |
| 589/590 | L33Y/E174H/D334T | +++ | ++ |
| 591/592 | H218P | ++ | + |
| 593/594 | H218C | ++ | + |
| 595/596 | G26A | + | + |
| 597/598 | K34L | ++ | + |

TABLE 4-4-continued

Triacylglycerol Lipase Activity (Relative to SEQ ID NO: 442)[1]

| SEQ ID NO: (nt/aa) | Amino Acid Differences (Relative to SEQ ID NO: 442) | FIOP After Multistep Heat and GI Challenge Screen with Taurocholate | FIOP After Multistep Heat and GI Challenge without Taurocholate |
|---|---|---|---|
| 599/600 | A189H | | + |
| 601/602 | G26S | ++ | + |
| 603/604 | G26R | | + |
| 605/606 | L33Y/Q193L | +++ | + |
| 607/608 | L33Y/L175G/H218M/ D334T/Q339K | ++ | + |
| 609/610 | Q193L | ++ | + |
| 611/612 | I144L | + | + |
| 613/614 | K210V | ++ | + |
| 615/616 | R46P | ++ | + |
| 617/618 | L175G/H218M/N375A | ++ | + |
| 619/620 | Y48L | ++ | |
| 621/622 | H218M | ++ | |
| 623/624 | E174H/H218M/ G271D/A303P | ++ | |
| 625/626 | L175G/Q193L/ H218M/L243R | ++ | |
| 627/628 | Q193L/Q293R/A303P | +++ | |
| 629/630 | K194T | + | |
| 631/632 | E174H | ++ | |

[1]Levels of increased activity were determined relative to the reference polypeptide of SEQ ID NO: 442 and defined as follows: "+" > 0.9; "++" > 1.1; "+++" > 2; and "++++" > 5.

Based on the results shown in Table 4-4, SEQ ID NO: 540 was chosen as the next parent sequence for the next iteration of protein optimization. Beneficial mutations identified based on the results shown in Table 4-4 were recombined into the backbone. Additionally, variants were also constructed on SEQ ID NO: 540, through saturation mutagenesis at different positions. The variants were assayed as described in Example 3, and the results are provided in Table 4-5. In this Table, the amino acid differences are indicated relative to SEQ ID NO: 540.

TABLE 4-5

Triacylglycerol Lipase Activity (Relative to SEQ ID NO: 540)

| SEQ ID NO: (nt/aa) | Amino Acid Differences (Relative to SEQ ID NO: 540) | FIOP After Multistep Heat and GI Challenge with Taurocholate |
|---|---|---|
| 633/634 | V49T/M252V/S344H | ++ |
| 635/636 | F38G/E174G/Q193L/A303P | ++ |
| 637/638 | F38G/E174H/M225L/ L243R/G281K/N330H | ++ |
| 639/640 | E174G/M225L/L243R/ G281P/A303P/F345I | ++ |
| 641/642 | E174R/A303P | ++ |
| 643/644 | F38G/E174H/Q195L/G281P/N330F | ++ |
| 645/646 | K34L/F38G/E174R/M225L/A303P | ++ |
| 647/648 | F38G/E174G/G281K/A303P | ++ |
| 649/650 | E174R/Q193L/A303P/N330H | ++ |
| 651/652 | F38A/Q195Y/G281K/A303P/N330F | ++ |
| 653/654 | V49T/E123Q/M252V/S344H | ++ |
| 655/656 | K34L/G281P/N330H | ++ |
| 657/658 | E174R/Q195I/G281K/A303P | ++ |
| 659/660 | K34L/F38A/E174R/A303P/F345I | ++ |
| 661/662 | F38G/E174H/G281K | ++ |
| 663/664 | K34L/F38A/E174G/Q193L/ Q195L/L243R/G281P/A303P/N330F | ++ |
| 665/666 | F38G/Q195Y/L243R/A303P | ++ |
| 667/668 | V49T/S344H | ++ |
| 669/670 | K34L/E174G/Q193L/ Q195L/L243R/G28IP | ++ |
| 671/672 | K34L/Q193L/L243R/ A303P/N330F | ++ |
| 673/674 | E174G/Q195I/M225L/ G281K/A303P/N330F/F345I | ++ |
| 675/676 | F38A/Q195I/A303P | ++ |
| 677/678 | K34L/Q193L/Q195I/M225L/L243R | ++ |
| 679/680 | S344W | ++ |
| 681/682 | V49T/L311W/S344H | ++ |
| 683/684 | E123Q/M252V/S344H | ++ |
| 685/686 | Q195Y/M225L/A303P/N330H | ++ |
| 687/688 | K34L/E174H/Q193L/ Q195I/A303P/N330F | ++ |
| 689/690 | V49T/G98P/M120T/M252V/S344H | ++ |
| 691/692 | T51A/M252V/S344H | ++ |
| 693/694 | K34L/E174G | ++ |
| 695/696 | E174H/G281P/N330H | ++ |
| 697/698 | F38A/E174R/G281K/A303P/F345I | ++ |
| 699/700 | T51A/S344H | ++ |
| 701/702 | F38G/E174R/Q193L/ Q195L/L243R/N330H | ++ |
| 703/704 | L161I | ++ |
| 705/706 | S344I | ++ |
| 707/708 | E174R/Q193L/Q195I/M225L | ++ |
| 709/710 | F38G/Q195I/G281P/N330F | ++ |
| 711/712 | S344V | ++ |
| 713/714 | F38A/Q193L/Q195L/M225L/ A303P/F345I | ++ |
| 715/716 | V49T/M120T/M252V/S344H | ++ |
| 717/718 | F38A/E174H/Q193L/M225L/ T274D/M283I/A303P/N330F | ++ |
| 719/720 | V49T/T51A/G98P/M252V/L311W | ++ |
| 721/722 | V49T | ++ |
| 723/724 | G98P/S344H | ++ |
| 725/726 | V49T/E123Q/T264S/S344H | ++ |
| 727/728 | E174H/Q195I/L243R/ G281K/F345I | ++ |
| 729/730 | S268T | ++ |
| 731/732 | F38G | ++ |
| 733/734 | V49S | ++ |
| 735/736 | S160T | ++ |
| 737/738 | V49T/T51A/E123Q/M252V/S344H | ++ |
| 739/740 | T51V | + |
| 741/742 | M252V | + |
| 743/744 | V49T/E123Q/L311W | + |
| 745/746 | G98R | + |
| 747/748 | S129F | + |

[1]Levels of increased activity were determined relative to the reference polypeptide of SEQ ID NO: 540 and defined as follows: "+" > 0.9, "++" > 1.1, "+++" > 2, and "++++" > 5.

Based on the results shown in Table 4-5, SEQ ID NO: 646 was chosen as the next parent sequence for the next iteration of protein optimization. Beneficial mutations identified based on the results shown in Table 4-5 were recombined into the backbone. The variants were assayed as described in Example 3, and the results are provided in Table 4-6. In this Table, the amino acid differences are indicated relative to SEQ ID NO: 646.

TABLE 4-6

Triacylglycerol Lipase Activity (Relative to SEQ ID NO: 646)[1]

| SEQ ID NO: (nt/aa) | Amino Acid Differences (Relative to SEQ ID NO: 646) | FIOP After Multistep Heat and GI Challenge Screen |
|---|---|---|
| 749/750 | Q193L/M252V/G281P/S344H | +++ |
| 751/752 | L34K/Q193L/S268T/G281P | +++ |
| 753/754 | Q193L/L243R/G281P/S344W | +++ |

TABLE 4-6-continued

Triacylglycerol Lipase Activity (Relative to SEQ ID NO: 646)[1]

| SEQ ID NO: (nt/aa) | Amino Acid Differences (Relative to SEQ ID NO: 646) | FIOP After Multistep Heat and GI Challenge Screen |
|---|---|---|
| 755/756 | L34K/V49T/Q193L/S344H | +++ |
| 757/758 | L34K/V49T/L161I/Q193L/L243R/S344H | +++ |
| 759/760 | L34K/L161I/Q193L/L243R/S344W | +++ |
| 761/762 | L34K/V49T/L161I/Q193L/S344W | +++ |
| 763/764 | L34K/V49T/Q193L/L243R/M252V/S344W | +++ |
| 765/766 | L34K/L161I/Q193L/M252V7S344W | +++ |
| 767/768 | Q193L/M252V/S268T/S344V | +++ |
| 769/770 | L34K/Q193L/L243R/M252V/S344W | +++ |
| 771/772 | L34K/M252V/S344V | +++ |
| 773/774 | L34K/Q193L/M252V/S268T/S344H | +++ |
| 775/776 | V49T/Q193L/S197G/L243R/M252V/G281P/S344H | ++ |
| 777/778 | V49T/L161I/Q193L/L243R/M252V/S344W | ++ |
| 779/780 | L34K/L161I/Q193L/L243R/S268T/S344V | ++ |
| 781/782 | L34K/V49T/L161I/M252V/S268T/S344V | ++ |
| 783/784 | L34K/L16I/Q193L/M252V/S268T/S344V | ++ |
| 785/786 | L34K/V49T/L161I/Q193L/L243R/S344V | ++ |
| 787/788 | L34K/L161I/Q193L/M252V/S344V | ++ |
| 789/790 | V49T/Q193L/L243R/M252V/S344V | ++ |
| 791/792 | L34K/L161I/S344V | ++ |
| 793/794 | L34K/L161I/Q193L/S268T/S344H | ++ |
| 795/796 | Y67A/W154Y/A237Q/F287L | ++ |
| 797/798 | Y67A/S168T/A237Q/F287L | ++ |
| 799/800 | L34K/V49T/Q193L/S344W | ++ |
| 801/802 | L34K/L161I/S344W | ++ |
| 803/804 | L34K/V49T/M252V/S268T/S344V | ++ |
| 805/806 | V49T/L161I/L243R/M252V/S344V | ++ |
| 807/808 | A237Q/F287L/S291A | ++ |
| 809/810 | W154Y/L286V/F287L | ++ |
| 811/812 | Y67A/S16817/A237Q | ++ |
| 813/814 | H186T/L187A/Y278L | ++ |
| 815/816 | L34K/L161I/L243R/G281P/S344V | ++ |
| 817/818 | L34K/L161I/Q193L/L243R/M252V/S268T | ++ |
| 819/820 | V49T/Q193L/L243R/S344W | ++ |
| 821/822 | V49T/L161I/7Q193L/M252V/G281P/S344H | ++ |
| 823/824 | S168T/A237Q | ++ |
| 825/826 | F24M/Y278L | ++ |
| 827/828 | L34K/L161I/7Q193L/M252V/S268T/S344H | ++ |
| 829/830 | L161I/Q193L/M252V/S344V | ++ |
| 831/832 | L16F/Y67A/A237Q/F287L/S291A | ++ |
| 833/834 | L34K/L161I/Q193L/M252V/S344H | ++ |
| 835/836 | L161I/Q193L/S344W | ++ |
| 837/838 | Y67A/V177L/A237Q | ++ |
| 839/840 | L16F/Y67A/W154Y/S168T/A237Q/T241S/F287L | ++ |
| 841/842 | W154Y/A237Q/L286V/F287L | ++ |
| 843/844 | L34K/V49T/L161I/L243R/S344H | ++ |
| 845/846 | V49T/L243R/S344V | ++ |
| 847/848 | L34K/M252V/S268T/G281P/S344V | ++ |
| 849/850 | VI1I/Y67A/S168T/7F287L | ++ |
| 851/852 | A237Q | ++ |
| 853/854 | V11I/L16F/Y67A/S168T/I180V/F287L | ++ |
| 855/856 | V11I/L16F/A237Q/T241S/F287L | ++ |
| 857/858 | L161I/S344W | ++ |
| 859/860 | G281P/S344W | ++ |
| 861/862 | L34K/V49T/L243R/M252V | + |
| 863/864 | L16F/S168T/V177L | + |
| 865/866 | F24M | + |

[1]Levels of increased activity were determined relative to the reference polypeptide of SEQ ID NO: 646, and defined as follows: "+" > 0.9; "++" > 1.1; "+++" > 2; and "++++" > 5.

Based on the results shown in Table 4-6, SEQ ID NO: 758 was chosen as the next parent sequence for the next iteration of protein optimization. Beneficial mutations identified based on the results shown in Table 4-6 were recombined into the backbone. The variants were assayed as described in Example 3, and the results are provided in Table 4-7. In this Table, the amino acid differences are indicated relative to SEQ ID NO: 758.

TABLE 4-7

Triacylglycerol Lipase Activity (Relative to SEQ ID NO: 758)[1]

| SEQ ID NO: (nt/aa) | Amino Acid Differences (Relative to SEQ ID NO: 758) | FIOP After Multistep Heat and GI Challenge Screen |
|---|---|---|
| 867/868 | F24M/M252V/F287L | ++ |
| 869/870 | M252V/F287L/H344S | ++ |
| 871/872 | F24M/M252V | ++ |
| 873/874 | G281P | ++ |
| 875/876 | F24M/S168T/M252V/G281P | ++ |
| 877/878 | F24M/H344W | ++ |
| 879/880 | P213S/M252V/Y278L/H344S | + |
| 881/882 | M252V/Y278L/H344W | + |
| 883/884 | F24M/A237Q/F287L/H344S | + |

[1]Levels of increased activity were determined relative to the reference polypeptide of SEQ ID NO: 758, and defined as follows: "+" > 0.9; "++" > 1.1; "+++" > 2; and "++++" > 5.

Example 5

Screening Results for Individual Mutation Variants on SEQ ID NO:868

Single point mutations were constructed on SEQ ID NO:868 through site saturation mutagenesis at the 24 positions that differ from SEQ ID NO:2. These variants were assayed for lipase activity after being subjected to various pre-treatments as described in Example 3. Each variant was tested in triplicate, and analysis of the activity data in reference to both SEQ ID NO:868 and SEQ ID NO: 2, are listed in Table 5-1.

TABLE 5-1

Lipase Activity After Various Challenge Conditions (Relative to SEQ ID NO: 2 and SEQ ID NO: 868)[1]

| SEQ ID NO: (nt/aa) | Amino Acid Substitutions[2] | Exp. #1[3] | Exp. #2[4] | Exp. #3[5] | Exp. #4[6] | Exp. #5[7] | Exp. #6[8] | Exp. #7[9] | Exp. #8[10] | Exp. #9[11] | Exp. #10[12] |
|---|---|---|---|---|---|---|---|---|---|---|---|
| 867/868 | | ++++ | ++++ | +++++ | ++++ | +++++ | ++ | ++ | ++ | ++ | ++ |
| 01/02 | M24F/G38F/T49V/ H70K/E149T/ I161L/R174E/L175Q/ A189S/L193Q/ L225M/E231Q/ R243L/V252M/ D271G/L287F/ L292M/R293Q/ R296S/P303A/ T334D/H344S/ F373Y/P385F | ++ | ++ | ++ | ++ | ++ | + | + | | + | |
| 885/886 | M24A | +++ | ++++ | ++++ | ++++ | +++++ | + | + | + | + | + |
| 887/888 | M24C | ++++ | ++++ | ++++ | ++++ | +++++ | ++ | ++ | + | + | + |
| 889/890 | M24D | +++ | ++++ | +++ | +++ | +++++ | + | + | + | + | + |
| 891/892 | M24E | | + | + | + | + | | | | | |
| 893/894 | M24F | + | + | + | + | ++ | | | | | |
| 895/896 | M24G | +++ | ++++ | ++++ | +++ | +++++ | + | + | + | + | + |
| 897/898 | M24H | +++ | ++++ | ++++ | +++ | +++++ | + | + | + | + | + |
| 899/900 | M24I | +++ | ++++ | ++++ | ++++ | +++++ | + | + | + | ++ | + |
| 901/902 | M24K | +++ | ++++ | +++ | +++ | +++++ | + | + | + | + | + |
| 903/904 | M24L | +++ | ++++ | ++++ | ++++ | +++++ | ++ | + | + | + | + |
| 905/906 | M24N | +++ | ++++ | ++++ | ++++ | +++++ | + | + | + | + | + |
| 907/908 | M24P | +++ | +++ | +++ | +++ | +++++ | + | + | + | + | + |
| 909/910 | M24Q | +++ | ++++ | ++++ | +++ | +++++ | + | + | + | + | + |
| 911/912 | M24R | +++ | ++++ | +++ | ++++ | +++++ | + | + | + | + | + |
| 913/914 | M24S | +++ | ++++ | ++++ | ++++ | +++++ | + | + | + | ++ | + |
| 915/916 | M24T | + | + | + | + | +++ | | | | | |
| 917/918 | M24V | +++ | ++++ | ++++ | ++++ | +++++ | + | + | ++ | + | + |
| 919/920 | M24W | +++ | ++++ | ++++ | ++++ | +++++ | + | + | + | + | + |
| 921/922 | M24Y | +++ | ++++ | ++++ | ++++ | +++++ | + | + | + | + | + |
| 923/924 | G38A | ++++ | ++++ | +++++ | ++++ | +++++ | +++ | +++ | ++ | ++ | + |
| 925/926 | G38C | ++++ | ++++ | +++++ | ++++ | +++++ | + | ++ | + | + | + |
| 927/928 | G38D | ++++ | ++++ | ++++ | ++++ | +++++ | + | ++ | + | + | + |
| 929/930 | G38E | ++++ | ++++ | +++++ | ++++ | +++++ | + | ++ | + | ++ | + |
| 931/932 | G38F | ++++ | ++++ | +++++ | ++++ | +++++ | ++ | ++ | ++ | ++ | + |
| 933/934 | G38H | ++++ | ++++ | +++++ | ++++ | +++++ | ++ | ++ | ++ | + | + |
| 935/936 | G38I | ++++ | ++++ | ++++ | ++++ | +++++ | + | ++ | + | ++ | + |
| 937/938 | G38K | ++++ | ++++ | ++++ | ++++ | +++++ | + | ++ | + | ++ | + |
| 939/940 | G38L | ++++ | ++++ | +++++ | ++++ | +++++ | ++ | ++ | ++ | ++ | + |
| 941/942 | G38M | ++++ | ++++ | +++++ | ++++ | +++++ | ++ | ++ | ++ | ++ | + |
| 943/944 | G38N | ++++ | ++++ | +++++ | ++++ | +++++ | + | ++ | ++ | ++ | + |
| 945/946 | G38P | ++++ | ++++ | ++++ | ++++ | +++++ | + | ++ | + | + | + |
| 947/948 | G38Q | ++++ | ++++ | +++++ | ++++ | +++++ | ++ | ++ | ++ | + | + |
| 949/950 | G38R | ++++ | ++++ | +++++ | ++++ | +++++ | ++ | ++ | ++ | +++ | ++ |
| 951/952 | G38S | ++++ | ++++ | +++++ | ++++ | +++++ | + | ++ | + | ++ | + |
| 953/954 | G38T | ++++ | ++++ | +++++ | ++++ | +++++ | + | ++ | + | ++ | + |
| 955/956 | G38V | ++++ | ++++ | +++++ | ++++ | +++++ | ++ | ++ | ++ | ++ | + |
| 957/958 | G38W | ++++ | ++++ | +++++ | ++++ | +++++ | + | ++ | + | + | + |
| 959/960 | G38Y | ++++ | ++++ | +++++ | ++++ | +++++ | ++ | ++ | ++ | ++ | + |
| 961/962 | T49A | +++ | ++++ | ++++ | ++++ | +++++ | + | ++ | + | ++ | + |
| 963/964 | T49C | +++ | ++++ | ++++ | ++++ | +++++ | + | + | + | ++ | + |
| 965/966 | T49D | +++ | ++++ | ++++ | ++++ | +++++ | + | + | + | + | + |
| 967/968 | T49E | +++ | ++++ | ++++ | ++++ | +++++ | + | + | + | + | + |
| 969/970 | T49F | +++ | ++++ | ++++ | ++++ | +++++ | + | + | + | + | + |
| 971/972 | T49G | +++ | +++ | ++++ | ++++ | +++++ | ++ | + | + | ++ | + |
| 973/974 | T49H | +++ | ++++ | ++++ | +++ | +++++ | ++ | ++ | + | + | + |
| 975/976 | T49I | +++ | +++ | ++++ | ++++ | +++++ | + | + | ++ | ++ | + |
| 977/978 | T49K | +++ | +++ | ++++ | +++ | +++++ | + | + | + | + | + |
| 979/980 | T49L | +++ | +++ | ++++ | ++++ | +++++ | ++ | + | + | ++ | + |
| 981/982 | T49M | +++ | +++ | ++++ | ++++ | +++++ | ++ | + | ++ | ++ | + |
| 983/984 | T49N | +++ | +++ | ++++ | ++++ | +++++ | ++ | + | ++ | ++ | + |
| 985/986 | T49P | +++ | +++ | ++++ | ++++ | +++++ | ++ | ++ | ++ | ++ | + |
| 987/988 | T49Q | +++ | +++ | ++++ | ++++ | +++++ | ++ | + | ++ | ++ | + |
| 989/990 | T49R | +++ | +++ | ++++ | +++ | +++++ | + | + | + | + | + |
| 991/992 | T49S | +++ | +++ | ++++ | ++++ | +++++ | + | ++ | ++ | ++ | + |
| 993/994 | T49V | +++ | +++ | ++++ | ++++ | +++++ | + | ++ | + | ++ | + |
| 995/996 | T49W | +++ | +++ | ++++ | ++++ | +++++ | + | + | ++ | + | + |
| 997/998 | T49Y | + | + | + | ++ | +++ | | + | | + | |
| 999/1000 | H70A | ++++ | ++++ | +++++ | ++++ | +++++ | ++ | ++ | + | ++ | ++ |
| 1001/1002 | H70C | +++ | +++ | ++++ | ++++ | +++++ | ++ | ++ | ++ | ++ | ++ |
| 1003/1004 | H70D | +++ | ++++ | ++++ | ++++ | +++++ | + | + | + | + | + |
| 1005/1006 | H70E | ++++ | ++++ | +++++ | ++++ | +++++ | + | ++ | + | +++ | + |
| 1007/1008 | H70F | ++++ | ++++ | +++++ | ++++ | +++++ | + | ++ | + | ++ | + |

TABLE 5-1-continued

Lipase Activity After Various Challenge Conditions (Relative to SEQ ID NO: 2 and SEQ ID NO: 868)[1]

| SEQ ID NO: (nt/aa) | Amino Acid Substitutions[2] | Exp. #1[3] | Exp. #2[4] | Exp. #3[5] | Exp. #4[6] | Exp. #5[7] | Exp. #6[8] | Exp. #7[9] | Exp. #8[10] | Exp. #9[11] | Exp. #10[12] |
|---|---|---|---|---|---|---|---|---|---|---|---|
| 1009/1010 | H70G | ++++ | ++++ | +++++ | ++++ | +++++ | ++ | ++ | + | ++ | + |
| 1011/1012 | H70I | +++++ | ++++ | +++++ | ++++ | +++++ | ++ | ++ | ++ | ++ | ++ |
| 1013/1014 | H70K | +++ | ++++ | +++++ | ++++ | +++++ | + | ++ | ++ | ++ | + |
| 1015/1016 | H70L | ++++ | ++++ | +++++ | ++++ | +++++ | ++ | ++ | ++ | + | + |
| 1017/1018 | H70M | ++++ | ++++ | +++++ | ++++ | +++++ | ++ | ++ | ++ | + | ++ |
| 1019/1020 | H70N | +++++ | ++++ | +++++ | ++++ | +++++ | ++ | ++ | ++ | + | + |
| 1021/1022 | H70P | + | + | + | + | +++ | | + | | | |
| 1023/1024 | H70Q | + | + | + | + | ++ | | | | | |
| 1025/1026 | H70R | ++++ | ++++ | +++++ | ++++ | +++++ | ++ | ++ | ++ | ++ | ++ |
| 1027/1028 | H70S | ++++ | ++++ | +++++ | ++++ | +++++ | + | ++ | + | ++ | + |
| 1029/1030 | H70T | ++++ | ++++ | +++++ | ++++ | +++++ | ++ | ++ | + | ++ | + |
| 1031/1032 | H70V | ++++ | ++++ | +++++ | ++++ | +++++ | + | ++ | ++ | ++ | ++ |
| 1033/1034 | H70W | ++++ | ++++ | +++++ | +++++ | +++++ | + | ++ | + | +++ | + |
| 1035/1036 | H70Y | ++++ | ++++ | +++++ | ++++ | +++++ | + | ++ | + | ++ | + |
| 1037/1038 | E149A | +++ | ++++ | ++++ | ++++ | +++++ | ++ | + | ++ | + | + |
| 1039/1040 | E149C | +++ | ++++ | ++++ | ++++ | +++++ | ++ | ++ | ++ | ++ | ++ |
| 1041/1042 | E149D | | + | + | + | + | | | | | |
| 1043/1044 | E149F | +++ | ++++ | ++++ | ++++ | +++++ | + | + | ++ | + | ++ |
| 1045/1046 | E149G | +++ | ++++ | ++++ | ++++ | +++++ | + | + | + | + | + |
| 1047/1048 | E149H | +++ | ++++ | ++++ | ++++ | +++++ | ++ | ++ | ++ | ++ | ++ |
| 1049/1050 | E149I | +++ | ++++ | ++++ | ++++ | +++++ | ++ | ++ | ++ | ++ | ++ |
| 1051/1052 | E149K | +++ | ++++ | +++++ | ++++ | +++++ | ++ | ++ | +++ | + | ++ |
| 1053/1054 | E149L | +++ | ++++ | +++++ | ++++ | +++++ | ++ | ++ | +++ | + | ++ |
| 1055/1056 | E149M | +++ | ++++ | +++++ | ++++ | +++++ | +++ | ++ | +++ | + | ++ |
| 1057/1058 | E149N | +++ | ++++ | ++++ | ++++ | +++++ | ++ | ++ | + | + | + |
| 1059/1060 | E149P | +++ | +++ | +++ | ++++ | +++++ | + | + | + | + | + |
| 1061/1062 | E149Q | +++ | ++++ | ++++ | ++++ | +++++ | ++ | ++ | ++ | ++ | ++ |
| 1063/1064 | E149R | ++++ | ++++ | ++++ | ++++ | +++++ | +++ | ++ | ++ | ++ | ++ |
| 1065/1066 | E149S | ++++ | ++++ | ++++ | ++++ | +++++ | +++ | ++ | ++ | ++ | + |
| 1067/1068 | E149T | ++++ | ++++ | ++++ | ++++ | +++++ | +++ | ++ | ++ | ++ | ++ |
| 1069/1070 | E149V | | + | + | + | + | | | | | |
| 1071/1072 | E149W | +++ | ++++ | ++++ | ++++ | +++++ | ++ | ++ | + | ++ | + |
| 1073/1074 | E149Y | +++ | ++++ | ++++ | ++++ | +++++ | + | + | + | + | + |
| 1075/1076 | I161A | ++++ | ++++ | ++++ | ++++ | +++++ | + | ++ | + | + | + |
| 1077/1078 | I161C | ++++ | ++++ | ++++ | ++++ | +++++ | + | ++ | + | + | + |
| 1079/1080 | I161D | +++ | ++++ | +++ | +++ | ++++ | + | + | + | + | + |
| 1081/1082 | I161E | ++++ | ++++ | ++++ | ++++ | +++++ | + | ++ | + | + | + |
| 1083/1084 | I161F | ++++ | ++++ | ++++ | ++++ | +++++ | + | + | + | + | + |
| 1085/1086 | I161G | ++++ | ++++ | ++++ | ++++ | +++++ | + | + | + | + | + |
| 1087/1088 | I161H | +++ | ++++ | ++++ | ++++ | +++++ | + | + | ++ | + | |
| 1089/1090 | I161K | +++ | ++++ | ++++ | ++++ | +++ | + | + | ++ | | |
| 1091/1092 | I161L | ++++ | ++++ | ++++ | ++++ | +++++ | + | + | + | + | + |
| 1093/1094 | I161M | ++++ | ++++ | ++++ | ++++ | +++++ | + | + | + | + | + |
| 1095/1096 | I161N | + | + | + | + | +++ | | | | | |
| 1097/1098 | I161P | +++ | +++ | ++++ | ++++ | +++++ | + | + | + | + | + |
| 1099/1100 | I161Q | +++ | ++++ | +++ | ++++ | ++++ | + | + | + | + | + |
| 1101/1102 | I161R | + | ++ | + | +++ | ++ | | + | | + | |
| 1103/1104 | I161S | +++ | +++ | +++ | ++++ | ++++ | + | + | + | + | + |
| 1105/1106 | I161T | +++ | ++++ | +++ | ++++ | +++++ | + | + | + | + | + |
| 1107/1108 | I161V | ++++ | ++++ | +++++ | ++++ | +++++ | + | + | + | + | + |
| 1109/1110 | I161W | +++ | +++ | +++ | +++ | +++ | + | + | | + | |
| 1111/1112 | I161Y | +++ | ++++ | +++ | ++++ | +++++ | + | ++ | + | + | + |
| 1113/1114 | R174A | +++ | ++++ | ++++ | ++++ | +++++ | ++ | + | + | + | + |
| 1115/1116 | R174C | +++ | ++++ | ++++ | ++++ | +++++ | + | + | + | ++ | ++ |
| 1117/1118 | R174D | +++ | ++++ | ++++ | ++++ | +++++ | + | + | + | + | + |
| 1119/1120 | R174E | +++ | ++++ | ++++ | ++++ | +++++ | + | + | + | + | + |
| 1121/1122 | R174F | +++ | ++++ | ++++ | ++++ | +++++ | + | + | + | ++ | + |
| 1123/1124 | R174G | + | ++ | + | + | +++ | | | | | |
| 1125/1126 | R174H | + | +++ | +++ | +++ | +++ | + | + | + | + | |
| 1127/1128 | R174I | +++ | ++++ | ++++ | ++++ | +++++ | + | + | + | ++ | + |
| 1129/1130 | R174K | +++ | ++++ | ++++ | ++++ | +++++ | + | ++ | ++ | ++ | ++ |
| 1131/1132 | R174L | +++ | ++++ | ++++ | ++++ | +++++ | + | + | + | ++ | + |
| 1133/1134 | R174M | +++ | ++++ | ++++ | ++++ | +++++ | + | + | + | + | + |
| 1135/1136 | R174N | +++ | ++++ | ++++ | ++++ | +++++ | + | + | + | + | + |
| 1137/1138 | R174P | +++ | ++++ | ++++ | ++++ | +++++ | + | + | + | ++ | + |
| 1139/1140 | R174Q | +++ | ++++ | ++++ | ++++ | +++++ | + | + | + | + | + |
| 1141/1142 | R174S | + | ++ | + | +++ | ++++ | | | | + | |
| 1143/1144 | R174T | +++ | ++++ | ++++ | ++++ | +++++ | + | + | + | ++ | ++ |
| 1145/1146 | R174V | ++++ | ++++ | +++++ | ++++ | +++++ | ++ | ++ | ++ | ++ | + |
| 1147/1148 | R174W | ++++ | ++++ | ++++ | ++++ | +++++ | + | + | + | + | + |
| 1149/1150 | R174Y | ++++ | ++++ | ++++ | ++++ | +++++ | + | ++ | + | ++ | + |
| 1151/1152 | L175A | ++++ | ++++ | ++++ | ++++ | +++++ | ++ | ++ | + | ++ | + |
| 1153/1154 | L175C | ++++ | +++++ | +++++ | ++++ | +++++ | ++ | ++ | ++ | ++ | + |
| 1155/1156 | L175D | ++++ | ++++ | ++++ | ++++ | +++++ | ++ | ++ | + | ++ | + |

TABLE 5-1-continued

Lipase Activity After Various Challenge Conditions (Relative to SEQ ID NO: 2 and SEQ ID NO: 868)[1]

| SEQ ID NO: (nt/aa) | Amino Acid Substitutions[2] | Exp. #1[3] | Exp. #2[4] | Exp. #3[5] | Exp. #4[6] | Exp. #5[7] | Exp. #6[8] | Exp. #7[9] | Exp. #8[10] | Exp. #9[11] | Exp. #10[12] |
|---|---|---|---|---|---|---|---|---|---|---|---|
| 1157/1158 | L175E | ++++ | ++++ | ++++ | ++++ | +++++ | ++ | ++ | + | ++ | + |
| 1159/1160 | L175F | ++++ | +++++ | ++++ | ++++ | +++++ | ++ | ++ | + | ++ | + |
| 1161/1162 | L175G | ++++ | ++++ | +++++ | ++++ | +++++ | +++ | ++ | +++ | ++ | ++ |
| 1163/1164 | L175H | ++++ | ++++ | ++++ | ++++ | +++++ | ++ | ++ | + | ++ | + |
| 1165/1166 | L175I | ++++ | ++++ | +++++ | ++++ | +++++ | ++ | ++ | ++ | ++ | + |
| 1167/1168 | L175K | ++++ | ++++ | ++++ | ++++ | +++++ | ++ | ++ | + | ++ | + |
| 1169/1170 | L175M | ++++ | ++++ | +++++ | ++++ | +++++ | ++ | ++ | ++ | + | ++ |
| 1171/1172 | L175N | ++++ | ++++ | ++++ | ++++ | +++++ | ++ | ++ | + | + | + |
| 1173/1174 | L175P | ++++ | ++++ | +++++ | ++++ | +++++ | ++ | ++ | ++ | ++ | + |
| 1175/1176 | L175Q | + | + | + | + | +++ | | | | | |
| 1177/1178 | L175R | ++++ | ++++ | +++++ | ++++ | +++++ | ++ | ++ | ++ | ++ | + |
| 1179/1180 | L175S | ++++ | ++++ | +++++ | ++++ | +++++ | ++ | ++ | ++ | ++ | + |
| 1181/1182 | L175T | +++ | ++++ | ++++ | ++++ | ++++ | + | ++ | + | ++ | + |
| 1183/1184 | L175V | +++ | ++++ | ++++ | ++++ | ++++ | + | ++ | + | ++ | + |
| 1185/1186 | L175W | ++++ | ++++ | ++++ | ++++ | +++++ | + | ++ | + | ++ | + |
| 1187/1188 | L175Y | ++++ | ++++ | +++++ | ++++ | +++++ | ++ | ++ | ++ | ++ | + |
| 1189/1190 | A189C | ++++ | ++++ | ++++ | ++++ | +++++ | +++ | ++ | ++ | ++ | + |
| 1191/1192 | A189D | ++++ | ++++ | +++++ | +++ | +++++ | +++ | ++ | +++ | + | + |
| 1193/1194 | A189E | ++++ | ++++ | ++++ | +++ | +++++ | +++ | + | ++ | + | + |
| 1195/1196 | A189F | +++ | ++++ | ++++ | ++++ | +++++ | +++ | ++ | ++ | ++ | ++ |
| 1197/1198 | A189G | ++++ | ++++ | ++++ | ++++ | +++++ | +++ | ++ | ++ | ++ | ++ |
| 1199/1200 | A189H | ++++ | ++++ | +++++ | +++ | +++++ | +++ | ++ | +++ | + | ++ |
| 1201/1202 | A189I | +++ | ++++ | ++++ | ++++ | +++++ | ++ | + | + | + | + |
| 1203/1204 | A189K | ++++ | ++++ | ++++ | +++ | +++++ | +++ | ++ | ++ | + | ++ |
| 1205/1206 | A189L | +++ | ++++ | ++++ | ++++ | +++++ | + | + | ++ | + | + |
| 1207/1208 | A189M | +++ | ++++ | ++++ | ++++ | +++++ | ++ | + | ++ | + | + |
| 1209/1210 | A189N | ++++ | ++++ | +++++ | +++ | +++++ | +++ | +++ | +++ | + | + |
| 1211/1212 | A189P | ++++ | ++++ | ++++ | +++ | +++++ | +++ | ++ | + | + | ++ |
| 1213/1214 | A189Q | ++++ | ++++ | ++++ | +++ | +++++ | +++ | ++ | + | + | + |
| 1215/1216 | A189R | +++ | ++++ | ++++ | +++ | +++++ | ++ | + | + | + | + |
| 1217/1218 | A189S | +++ | ++++ | ++++ | ++++ | +++++ | ++ | + | ++ | ++ | + |
| 1219/1220 | A189T | +++ | ++++ | ++++ | ++++ | +++++ | ++ | ++ | ++ | ++ | ++ |
| 1221/1222 | A189V | +++ | ++++ | ++++ | ++++ | +++++ | ++ | + | + | + | + |
| 1223/1224 | A189W | +++ | ++++ | ++++ | ++++ | +++++ | + | + | ++ | + | + |
| 1225/1226 | A189Y | +++ | ++++ | ++++ | ++++ | +++++ | +++ | + | + | + | ++ |
| 1227/1228 | L193A | + | + | + | + | +++ | | | | | |
| 1229/1230 | L193C | ++++ | ++++ | ++++ | ++++ | +++++ | + | ++ | + | + | + |
| 1231/1232 | L193D | ++++ | ++++ | ++++ | ++++ | +++++ | + | ++ | + | ++ | + |
| 1233/1234 | L193E | ++++ | ++++ | ++++ | ++++ | +++++ | + | ++ | + | ++ | + |
| 1235/1236 | L193F | ++++ | +++++ | ++++ | ++++ | +++++ | + | ++ | + | ++ | + |
| 1237/1238 | L193G | ++++ | ++++ | ++++ | ++++ | +++++ | + | ++ | + | ++ | + |
| 1239/1240 | L193H | ++++ | ++++ | ++++ | ++++ | +++++ | + | ++ | + | ++ | + |
| 1241/1242 | L193I | ++++ | +++++ | +++++ | ++++ | +++++ | + | ++ | ++ | ++ | + |
| 1243/1244 | L193K | ++++ | ++++ | ++++ | ++++ | +++++ | + | ++ | + | ++ | + |
| 1245/1246 | L193M | ++++ | +++++ | +++++ | ++++ | +++++ | ++ | ++ | ++ | ++ | ++ |
| 1247/1248 | L193N | ++++ | +++++ | ++++ | ++++ | +++++ | + | ++ | + | ++ | + |
| 1249/1250 | L193P | + | +++ | + | +++ | +++ | | + | | + | |
| 1251/1252 | L193Q | ++++ | ++++ | ++++ | ++++ | +++++ | + | ++ | + | ++ | + |
| 1253/1254 | L193R | ++++ | ++++ | ++++ | ++++ | +++++ | + | + | + | + | + |
| 1255/1256 | L193S | ++++ | ++++ | ++++ | ++++ | +++++ | + | ++ | + | ++ | + |
| 1257/1258 | L193T | ++++ | ++++ | ++++ | ++++ | +++++ | ++ | ++ | + | + | + |
| 1259/1260 | L193V | ++++ | ++++ | +++++ | ++++ | +++++ | ++ | ++ | ++ | ++ | + |
| 1261/1262 | L193W | ++++ | ++++ | ++++ | ++++ | +++++ | + | + | + | + | + |
| 1263/1264 | L193Y | ++++ | ++++ | ++++ | ++++ | +++++ | + | ++ | + | ++ | + |
| 1265/1266 | L225A | ++++ | +++++ | +++++ | ++++ | +++++ | ++ | ++ | ++ | ++ | + |
| 1267/1268 | L225C | ++++ | +++++ | +++++ | ++++ | +++++ | ++ | ++ | +++ | ++ | ++ |
| 1269/1270 | L225D | ++++ | +++++ | +++++ | ++++ | +++++ | + | ++ | + | ++ | + |
| 1271/1272 | L225E | ++++ | +++++ | +++++ | ++++ | +++++ | ++ | ++ | +++ | ++ | + |
| 1273/1274 | L225F | ++++ | +++++ | +++++ | ++++ | +++++ | ++ | ++ | +++ | ++ | ++ |
| 1275/1276 | L225G | ++++ | ++++ | ++++ | ++++ | +++++ | + | ++ | + | ++ | + |
| 1277/1278 | L225H | ++++ | ++++ | ++++ | ++++ | +++ | + | ++ | + | ++ | |
| 1279/1280 | L225I | ++++ | ++++ | +++++ | ++++ | +++++ | ++ | ++ | ++ | + | ++ |
| 1281/1282 | L225K | ++++ | ++++ | ++++ | ++++ | +++++ | + | ++ | + | + | + |
| 1283/1284 | L225M | ++++ | ++++ | +++++ | ++++ | +++++ | ++ | ++ | ++ | + | ++ |
| 1285/1286 | L225N | ++++ | ++++ | ++++ | ++++ | +++++ | + | ++ | + | + | + |
| 1287/1288 | L225P | +++ | ++++ | +++ | ++++ | +++ | + | + | + | ++ | |
| 1289/1290 | L225Q | ++++ | +++++ | +++++ | ++++ | +++++ | + | ++ | ++ | ++ | + |
| 1291/1292 | L225R | ++++ | +++++ | ++++ | ++++ | +++++ | + | ++ | + | ++ | + |
| 1293/1294 | L225S | ++++ | +++++ | +++++ | ++++ | +++++ | + | ++ | ++ | ++ | ++ |
| 1295/1296 | L225T | ++++ | +++++ | +++++ | ++++ | +++++ | ++ | ++ | +++ | ++ | ++ |
| 1297/1298 | L225V | ++++ | +++++ | +++++ | ++++ | +++++ | ++ | ++ | +++ | ++ | ++ |
| 1299/1300 | L225W | ++++ | +++++ | ++++ | ++++ | +++++ | + | ++ | + | ++ | + |
| 1301/1302 | L225Y | ++++ | ++++ | ++++ | ++++ | +++++ | ++ | ++ | + | ++ | + |
| 1303/1304 | E231A | +++ | ++++ | ++++ | ++++ | +++++ | ++ | ++ | +++ | ++ | ++ |

TABLE 5-1-continued

Lipase Activity After Various Challenge Conditions (Relative to SEQ ID NO: 2 and SEQ ID NO: 868)[1]

| SEQ ID NO: (nt/aa) | Amino Acid Substitutions[2] | Exp. #1[3] | Exp. #2[4] | Exp. #3[5] | Exp. #4[6] | Exp. #5[7] | Exp. #6[8] | Exp. #7[9] | Exp. #8[10] | Exp. #9[11] | Exp. #10[12] |
|---|---|---|---|---|---|---|---|---|---|---|---|
| 1305/1306 | E231C | +++ | ++++ | ++++ | ++++ | +++++ | ++ | + | ++ | + | ++ |
| 1307/1308 | E231D | +++ | ++++ | +++++ | ++++ | +++++ | ++ | ++ | +++ | + | ++ |
| 1309/1310 | E231F | +++ | ++++ | ++++ | ++++ | +++++ | + | + | ++ | ++ | + |
| 1311/1312 | E231G | +++ | ++++ | ++++ | ++++ | +++++ | ++ | ++ | + | ++ | + |
| 1313/1314 | E231H | +++ | ++++ | ++++ | ++++ | +++++ | + | ++ | + | ++ | ++ |
| 1315/1316 | E231I | +++ | ++++ | ++++ | ++++ | +++++ | ++ | ++ | + | ++ | + |
| 1317/1318 | E231K | +++ | ++++ | ++++ | ++++ | +++++ | + | + | + | + | + |
| 1319/1320 | E231L | +++ | ++++ | ++++ | ++++ | +++++ | + | ++ | + | ++ | + |
| 1321/1322 | E231M | +++ | ++++ | ++++ | ++++ | +++++ | ++ | ++ | + | + | ++ |
| 1323/1324 | E231N | +++ | ++++ | ++++ | ++++ | +++++ | ++ | ++ | ++ | ++ | ++ |
| 1325/1326 | E231P | +++ | ++++ | ++++ | +++ | +++++ | + | + | ++ | + | + |
| 1327/1328 | E231Q | + | +++ | +++ | +++ | +++ | + | + | + | + | |
| 1329/1330 | E231R | +++ | ++++ | ++++ | ++++ | +++++ | + | ++ | + | + | + |
| 1331/1332 | E231S | +++ | ++++ | ++++ | ++++ | +++++ | ++ | ++ | ++ | + | ++ |
| 1333/1334 | E231T | +++ | ++++ | ++++ | ++++ | +++++ | + | + | ++ | + | + |
| 1335/1336 | E231V | +++ | ++++ | ++++ | +++ | +++++ | + | ++ | ++ | + | + |
| 1337/1338 | E231W | +++ | ++++ | ++++ | +++ | +++++ | + | + | + | + | + |
| 1339/1340 | E231Y | +++ | ++++ | ++++ | +++ | +++++ | + | + | + | + | + |
| 1341/1342 | R243A | ++++ | ++++ | +++++ | ++++ | +++++ | ++ | ++ | +++ | + | +++ |
| 1343/1344 | R243C | ++++ | ++++ | +++++ | ++++ | +++++ | ++ | ++ | ++ | +++ | ++ |
| 1345/1346 | R243D | ++++ | ++++ | +++++ | ++++ | +++++ | + | ++ | + | ++ | + |
| 1347/1348 | R243E | ++++ | ++++ | +++++ | ++++ | +++++ | + | ++ | + | +++ | + |
| 1349/1350 | R243F | ++++ | ++++ | +++++ | ++++ | +++++ | + | ++ | ++ | ++ | ++ |
| 1351/1352 | R243G | ++++ | ++++ | +++++ | ++++ | +++++ | + | ++ | ++ | ++ | ++ |
| 1353/1354 | R243H | ++++ | ++++ | +++++ | ++++ | +++++ | ++ | ++ | ++ | + | ++ |
| 1355/1356 | R243I | ++++ | ++++ | +++++ | ++++ | +++++ | + | ++ | + | + | ++ |
| 1357/1358 | R243K | ++++ | ++++ | +++++ | ++++ | +++++ | + | ++ | ++ | ++ | ++ |
| 1359/1360 | R243L | ++++ | ++++ | +++++ | ++++ | +++++ | ++ | ++ | ++ | ++ | ++ |
| 1361/1362 | R243M | ++++ | ++++ | +++++ | ++++ | +++++ | + | ++ | ++ | + | ++ |
| 1363/1364 | R243N | ++++ | ++++ | +++++ | ++++ | +++++ | + | ++ | ++ | ++ | ++ |
| 1365/1366 | R243P | ++++ | ++++ | +++++ | ++++ | +++++ | + | ++ | ++ | ++ | ++ |
| 1367/1368 | R243Q | ++++ | ++++ | +++++ | ++++ | +++++ | + | ++ | + | ++ | ++ |
| 1369/1370 | R243S | + | + | + | + | +++ | | | | | |
| 1371/1372 | R243T | ++++ | ++++ | ++++ | ++++ | +++++ | + | ++ | + | + | + |
| 1373/1374 | R243V | ++++ | ++++ | +++++ | ++++ | +++++ | + | ++ | + | + | + |
| 1375/1376 | R243W | ++++ | ++++ | ++++ | ++++ | +++++ | + | ++ | + | + | + |
| 1377/1378 | R243Y | ++++ | ++++ | +++++ | ++++ | +++++ | + | ++ | ++ | + | ++ |
| 1379/1380 | V252A | +++ | ++++ | ++++ | ++++ | +++++ | ++ | ++ | ++ | ++ | ++ |
| 1381/1382 | V252C | +++ | +++ | ++++ | ++++ | +++++ | ++ | ++ | ++ | ++ | ++ |
| 1383/1384 | V252D | +++ | +++ | ++++ | ++++ | +++++ | ++ | ++ | ++ | ++ | ++ |
| 1385/1386 | V252E | +++ | +++ | ++++ | ++++ | +++++ | + | ++ | ++ | ++ | + |
| 1387/1388 | V252F | +++ | +++ | ++++ | ++++ | +++++ | ++ | + | ++ | ++ | + |
| 1389/1390 | V252G | +++ | +++ | ++++ | ++++ | +++++ | ++ | ++ | ++ | ++ | ++ |
| 1391/1392 | V252H | +++ | +++ | ++++ | ++++ | +++++ | ++ | ++ | ++ | ++ | ++ |
| 1393/1394 | V252I | +++ | +++ | ++++ | ++++ | +++++ | ++ | ++ | ++ | ++ | ++ |
| 1395/1396 | V252K | +++ | +++ | ++++ | ++++ | +++++ | ++ | ++ | ++ | ++ | + |
| 1397/1398 | V252L | +++ | +++ | ++++ | ++++ | +++++ | + | ++ | ++ | ++ | + |
| 1399/1400 | V252M | +++ | +++ | ++++ | ++++ | +++++ | + | ++ | ++ | ++ | ++ |
| 1401/1402 | V252N | +++ | ++++ | ++++ | ++++ | +++++ | ++ | ++ | ++ | ++ | ++ |
| 1403/1404 | V252P | +++ | +++ | ++++ | ++++ | +++++ | ++ | + | + | ++ | + |
| 1405/1406 | V252Q | +++ | +++ | ++++ | ++++ | +++++ | ++ | ++ | ++ | ++ | + |
| 1407/1408 | V252R | +++ | +++ | ++++ | ++++ | +++++ | ++ | ++ | ++ | ++ | + |
| 1409/1410 | V252S | +++ | ++++ | +++ | ++++ | +++++ | ++ | ++ | ++ | ++ | ++ |
| 1411/1412 | V252T | +++ | +++ | ++++ | ++++ | +++++ | ++ | + | ++ | ++ | ++ |
| 1413/1414 | V252W | +++ | ++++ | ++++ | ++++ | +++++ | ++ | ++ | + | ++ | ++ |
| 1415/1416 | V252Y | +++ | +++ | ++++ | ++++ | +++++ | ++ | ++ | ++ | ++ | + |
| 1417/1418 | D271A | +++ | ++++ | ++++ | ++++ | +++++ | ++ | ++ | + | ++ | ++ |
| 1419/1420 | D271C | +++ | ++++ | ++++ | ++++ | +++++ | ++ | ++ | ++ | ++ | ++ |
| 1421/1422 | D271E | ++++ | ++++ | ++++ | ++++ | +++++ | +++ | ++ | ++ | ++ | ++ |
| 1423/1424 | D271F | +++ | ++++ | ++++ | ++++ | +++++ | ++ | +++ | ++ | ++ | + |
| 1425/1426 | D271G | +++ | ++++ | ++++ | ++++ | +++++ | ++ | ++ | ++ | + | ++ |
| 1427/1428 | D271H | +++ | ++++ | ++++ | ++++ | +++++ | + | ++ | + | +++ | + |
| 1429/1430 | D271I | +++ | ++++ | ++++ | ++++ | +++++ | + | + | + | + | + |
| 1431/1432 | D271K | +++ | ++++ | ++++ | ++++ | +++++ | + | ++ | + | + | ++ |
| 1433/1434 | D271L | +++ | ++++ | ++++ | ++++ | +++++ | ++ | + | ++ | ++ | ++ |
| 1435/1436 | D271M | +++ | ++++ | ++++ | ++++ | +++++ | + | + | ++ | ++ | ++ |
| 1437/1438 | D271N | +++ | ++++ | +++++ | ++++ | +++++ | +++ | ++ | +++ | ++ | ++ |
| 1439/1440 | D271P | +++ | ++++ | ++++ | ++++ | +++++ | + | ++ | + | + | ++ |
| 1441/1442 | D271Q | +++ | ++++ | ++++ | ++++ | +++++ | ++ | ++ | ++ | ++ | ++ |
| 1443/1444 | D271R | +++ | ++++ | ++++ | ++++ | +++++ | ++ | ++ | ++ | + | ++ |
| 1445/1446 | D271S | +++ | ++++ | ++++ | ++++ | +++++ | ++ | ++ | ++ | ++ | ++ |
| 1447/1448 | D271T | +++ | ++++ | ++++ | ++++ | +++++ | + | ++ | ++ | + | + |
| 1449/1450 | D271V | +++ | ++++ | ++++ | ++++ | +++++ | + | +++ | ++ | + | + |
| 1451/1452 | D271W | +++ | ++++ | ++++ | ++++ | +++++ | + | ++ | + | +++ | + |

TABLE 5-1-continued

Lipase Activity After Various Challenge Conditions (Relative to SEQ ID NO: 2 and SEQ ID NO: 868)[1]

| SEQ ID NO: (nt/aa) | Amino Acid Substitutions[2] | Exp. #1[3] | Exp. #2[4] | Exp. #3[5] | Exp. #4[6] | Exp. #5[7] | Exp. #6[8] | Exp. #7[9] | Exp. #8[10] | Exp. #9[11] | Exp. #10[12] |
|---|---|---|---|---|---|---|---|---|---|---|---|
| 1453/1454 | D271Y | ++++ | ++++ | +++++ | ++++ | +++++ | +++ | ++ | +++ | ++ | ++ |
| 1455/1456 | L287A | +++ | ++++ | +++ | ++++ | ++++ | + | + | + | + | |
| 1457/1458 | L287C | ++++ | ++++ | ++++ | ++++ | +++++ | + | ++ | + | + | + |
| 1459/1460 | L287D | +++ | +++ | +++ | +++ | +++ | + | + | | + | |
| 1461/1462 | L287E | +++ | +++ | +++ | +++ | ++++ | + | + | + | + | |
| 1463/1464 | L287F | +++ | +++ | ++++ | ++++ | +++++ | ++ | + | + | ++ | + |
| 1465/1466 | L287G | +++ | ++++ | +++ | ++++ | ++ | + | + | + | + | |
| 1467/1468 | L287H | +++ | ++++ | +++ | ++++ | + | + | + | + | + | |
| 1469/1470 | L287I | ++++ | ++++ | ++++ | ++++ | +++++ | + | ++ | + | + | + |
| 1471/1472 | L287K | +++ | +++ | +++ | + | + | + | + | | | |
| 1473/1474 | L287M | ++++ | ++++ | +++++ | ++++ | +++++ | + | ++ | + | ++ | ++ |
| 1475/1476 | L287N | +++ | ++++ | +++ | ++++ | +++ | + | + | + | + | |
| 1477/1478 | L287P | +++ | ++++ | +++ | +++ | + | + | + | + | + | |
| 1479/1480 | L287Q | + | + | + | + | + | | | | | |
| 1481/1482 | L287R | + | +++ | + | + | + | | + | | | |
| 1483/1484 | L287S | +++ | ++++ | +++ | +++ | +++ | + | + | + | + | |
| 1485/1486 | L287T | +++ | ++++ | ++++ | ++++ | +++++ | + | + | + | + | + |
| 1487/1488 | L287V | | + | + | + | + | | | | | |
| 1489/1490 | L287W | +++ | ++++ | +++ | ++++ | +++ | + | + | + | + | |
| 1491/1492 | L287Y | +++ | ++++ | +++ | ++++ | ++++ | + | + | + | + | |
| 1493/1494 | L292A | ++++ | ++++ | ++++ | ++++ | +++++ | + | + | + | ++ | + |
| 1495/1496 | L292C | ++++ | ++++ | ++++ | ++++ | +++++ | + | ++ | + | ++ | + |
| 1497/1498 | L292D | +++ | ++++ | +++ | ++++ | ++++ | + | + | + | + | + |
| 1499/1500 | L292E | +++ | ++++ | +++ | ++++ | +++++ | + | + | + | + | + |
| 1501/1502 | L292F | ++++ | ++++ | ++++ | ++++ | +++++ | + | + | + | + | + |
| 1503/1504 | L292G | ++++ | ++++ | ++++ | ++++ | +++++ | + | + | + | + | + |
| 1505/1506 | L292H | ++++ | ++++ | ++++ | ++++ | +++++ | + | + | + | + | + |
| 1507/1508 | L292I | ++++ | ++++ | ++++ | ++++ | +++++ | ++ | ++ | + | ++ | ++ |
| 1509/1510 | L292K | ++++ | ++++ | ++++ | ++++ | +++++ | ++ | ++ | ++ | ++ | + |
| 1511/1512 | L292M | ++++ | ++++ | ++++ | ++++ | +++++ | ++ | ++ | ++ | +++ | ++ |
| 1513/1514 | L292N | +++ | ++++ | ++++ | ++++ | +++++ | + | + | + | + | + |
| 1515/1516 | L292P | +++ | ++++ | ++++ | ++++ | ++++ | + | + | + | ++ | + |
| 1517/1518 | L292Q | +++ | ++++ | ++++ | ++++ | +++++ | + | ++ | + | + | + |
| 1519/1520 | L292R | ++++ | ++++ | ++++ | ++++ | +++++ | ++ | ++ | ++ | + | + |
| 1521/1522 | L292S | +++ | ++++ | ++++ | ++++ | +++++ | + | + | + | + | + |
| 1523/1524 | L292T | +++ | ++++ | ++++ | ++++ | +++++ | ++ | ++ | + | + | + |
| 1525/1526 | L292V | ++++ | ++++ | ++++ | ++++ | +++++ | ++ | ++ | ++ | ++ | + |
| 1527/1528 | L292W | +++ | ++++ | ++++ | ++++ | +++++ | + | + | + | + | + |
| 1529/1530 | L292Y | ++++ | ++++ | ++++ | ++++ | +++++ | ++ | ++ | + | + | ++ |
| 1531/1532 | R293A | ++++ | ++++ | +++++ | ++++ | +++++ | + | ++ | + | ++ | +++ |
| 1533/1534 | R293C | ++++ | ++++ | +++++ | ++++ | +++++ | + | ++ | ++ | ++ | ++ |
| 1535/1536 | R293D | +++ | ++++ | ++++ | ++++ | +++++ | + | ++ | + | + | + |
| 1537/1538 | R293E | +++ | ++++ | ++++ | ++++ | +++++ | + | ++ | + | ++ | + |
| 1539/1540 | R293F | ++++ | ++++ | +++++ | ++++ | +++++ | +++ | ++ | ++ | ++ | + |
| 1541/1542 | R293G | ++++ | ++++ | ++++ | ++++ | +++++ | ++ | ++ | + | ++ | + |
| 1543/1544 | R293H | ++++ | ++++ | +++++ | ++++ | +++++ | ++ | ++ | ++ | + | ++ |
| 1545/1546 | R293I | ++++ | ++++ | +++++ | ++++ | +++++ | ++ | ++ | +++ | +++ | +++ |
| 1547/1548 | R293K | ++++ | ++++ | +++++ | ++++ | +++++ | + | ++ | + | + | ++ |
| 1549/1550 | R293L | ++++ | ++++ | +++++ | ++++ | +++++ | ++ | ++ | +++ | +++ | +++ |
| 1551/1552 | R293M | ++++ | ++++ | +++++ | ++++ | +++++ | ++ | ++ | ++ | +++ | ++ |
| 1553/1554 | R293N | ++++ | ++++ | ++++ | ++++ | +++++ | + | ++ | + | + | ++ |
| 1555/1556 | R293P | +++ | ++++ | ++++ | +++ | ++++ | + | + | + | + | + |
| 1557/1558 | R293Q | ++++ | ++++ | +++++ | ++++ | +++++ | ++ | ++ | ++ | ++ | +++ |
| 1559/1560 | R293S | ++++ | ++++ | +++++ | ++++ | +++++ | ++ | ++ | + | ++ | ++ |
| 1561/1562 | R293T | ++++ | ++++ | +++++ | ++++ | +++++ | ++ | ++ | ++ | ++ | ++ |
| 1563/1564 | R293V | ++++ | ++++ | +++++ | ++++ | +++++ | ++ | ++ | ++ | ++ | ++ |
| 1565/1566 | R293W | ++++ | ++++ | +++++ | ++++ | +++++ | ++ | ++ | +++ | +++ | +++ |
| 1567/1568 | R293Y | ++++ | ++++ | +++++ | ++++ | +++++ | ++ | ++ | + | + | ++ |
| 1569/1570 | R296A | +++ | ++++ | ++++ | ++++ | +++++ | + | ++ | + | ++ | ++ |
| 1571/1572 | R296C | ++++ | ++++ | +++++ | ++++ | +++++ | + | ++ | ++ | + | +++ |
| 1573/1574 | R296D | +++ | ++++ | ++++ | +++ | +++++ | + | ++ | + | + | + |
| 1575/1576 | R296E | +++ | ++++ | ++++ | ++++ | +++++ | + | ++ | + | + | + |
| 1577/1578 | R296F | +++ | ++++ | ++++ | ++++ | +++++ | + | + | + | + | + |
| 1579/1580 | R296G | | + | + | + | +++ | | | | | |
| 1581/1582 | R296H | ++++ | ++++ | +++++ | ++++ | +++++ | ++ | ++ | ++ | ++ | +++ |
| 1583/1584 | R296I | ++++ | ++++ | ++++ | ++++ | +++++ | + | ++ | + | ++ | + |
| 1585/1586 | R296K | ++++ | ++++ | +++++ | ++++ | +++++ | + | ++ | + | +++ | + |
| 1587/1588 | R296L | +++ | ++++ | ++++ | ++++ | +++++ | + | ++ | + | ++ | + |
| 1589/1590 | R296M | ++++ | ++++ | ++++ | ++++ | +++++ | + | ++ | + | ++ | + |
| 1591/1592 | R296N | ++++ | ++++ | +++++ | ++++ | +++++ | + | ++ | + | ++ | +++ |
| 1593/1594 | R296P | +++ | +++ | +++ | +++ | +++ | + | + | + | + | |
| 1595/1596 | R296Q | +++ | ++++ | +++++ | ++++ | +++++ | + | ++ | ++ | +++ | +++ |
| 1597/1598 | R296S | + | + | + | + | +++ | | | | | |
| 1599/1600 | R296T | ++++ | ++++ | +++++ | ++++ | +++++ | ++ | ++ | ++ | ++ | +++ |

TABLE 5-1-continued

Lipase Activity After Various Challenge Conditions (Relative to SEQ ID NO: 2 and SEQ ID NO: 868)[1]

| SEQ ID NO: (nt/aa) | Amino Acid Substitutions[2] | Exp. #1[3] | Exp. #2[4] | Exp. #3[5] | Exp. #4[6] | Exp. #5[7] | Exp. #6[8] | Exp. #7[9] | Exp. #8[10] | Exp. #9[11] | Exp. #10[12] |
|---|---|---|---|---|---|---|---|---|---|---|---|
| 1601/1602 | R296V | +++ | ++++ | ++++ | ++++ | +++++ | + | ++ | + | ++ | + |
| 1603/1604 | R296W | ++++ | ++++ | ++++ | ++++ | +++++ | + | ++ | + | ++ | + |
| 1605/1606 | R296Y | ++++ | ++++ | ++++ | ++++ | +++++ | + | ++ | + | ++ | + |
| 1607/1608 | P303A | ++++ | ++++ | ++++ | ++++ | +++++ | ++ | ++ | ++ | + | + |
| 1609/1610 | P303C | +++ | ++++ | ++++ | +++ | +++++ | ++ | ++ | ++ | + | + |
| 1611/1612 | P303D | +++ | ++++ | ++++ | ++++ | +++++ | ++ | ++ | + | ++ | + |
| 1613/1614 | P303E | ++++ | ++++ | ++++ | ++++ | +++++ | ++ | ++ | ++ | +++ | + |
| 1615/1616 | P303F | +++ | ++++ | ++++ | ++++ | +++++ | + | + | + | ++ | + |
| 1617/1618 | P303G | +++ | ++++ | ++++ | ++++ | +++++ | + | + | + | ++ | + |
| 1619/1620 | P303H | ++++ | ++++ | ++++ | ++++ | +++++ | ++ | ++ | ++ | ++ | + |
| 1621/1622 | P303I | +++ | ++++ | ++++ | ++++ | +++++ | ++ | ++ | + | ++ | + |
| 1623/1624 | P303K | ++++ | ++++ | ++++ | ++++ | +++++ | ++ | ++ | ++ | ++ | + |
| 1625/1626 | P303L | ++++ | ++++ | ++++ | ++++ | +++++ | ++ | ++ | ++ | +++ | + |
| 1627/1628 | P303M | ++++ | ++++ | ++++ | ++++ | +++++ | ++ | ++ | + | + | + |
| 1629/1630 | P303N | ++++ | ++++ | ++++ | ++++ | +++++ | ++ | ++ | ++ | + | + |
| 1631/1632 | P303Q | ++++ | ++++ | ++++ | ++++ | +++++ | ++ | ++ | + | ++ | + |
| 1633/1634 | P303R | ++++ | ++++ | ++++ | ++++ | +++++ | ++ | ++ | + | ++ | + |
| 1635/1636 | P303S | +++ | ++++ | ++++ | ++++ | +++++ | ++ | + | + | ++ | + |
| 1637/1638 | P303T | ++++ | ++++ | ++++ | ++++ | +++++ | ++ | ++ | + | ++ | + |
| 1639/1640 | P303V | +++ | ++++ | ++++ | ++++ | +++++ | + | + | + | + | + |
| 1641/1642 | P303W | +++ | ++++ | ++++ | ++++ | +++++ | ++ | + | + | ++ | + |
| 1643/1644 | P303Y | ++++ | ++++ | ++++ | ++++ | +++++ | ++ | + | + | ++ | + |
| 1645/1646 | T334A | + | ++ | + | + | ++++ | | + | | | |
| 1647/1648 | T334C | ++++ | ++++ | +++++ | ++++ | +++++ | ++ | ++ | ++ | +++ | ++ |
| 1649/1650 | T334D | ++++ | ++++ | +++++ | ++++ | +++++ | ++ | ++ | ++ | ++ | ++ |
| 1651/1652 | T334E | ++++ | ++++ | +++++ | ++++ | +++++ | ++ | ++ | ++ | ++ | ++ |
| 1653/1654 | T334F | ++++ | ++++ | +++++ | ++++ | +++++ | + | ++ | + | + | ++ |
| 1655/1656 | T334G | ++++ | ++++ | +++++ | ++++ | +++++ | + | ++ | + | + | ++ |
| 1657/1658 | T334H | ++++ | ++++ | +++++ | ++++ | +++++ | + | ++ | + | + | ++ |
| 1659/1660 | T334I | ++++ | ++++ | +++++ | ++++ | +++++ | ++ | ++ | ++ | +++ | ++ |
| 1661/1662 | T334K | ++++ | ++++ | +++++ | ++++ | +++++ | + | ++ | + | ++ | ++ |
| 1663/1664 | T334L | ++++ | ++++ | +++++ | ++++ | +++++ | + | ++ | + | +++ | ++ |
| 1665/1666 | T334M | ++++ | ++++ | +++++ | ++++ | +++++ | ++ | ++ | ++ | ++ | ++ |
| 1667/1668 | T334N | ++++ | ++++ | +++++ | ++++ | +++++ | ++ | ++ | ++ | ++ | ++ |
| 1669/1670 | T334P | ++++ | ++++ | +++++ | ++++ | +++++ | + | ++ | + | ++ | ++ |
| 1671/1672 | T334Q | ++++ | ++++ | +++++ | ++++ | +++++ | + | + | ++ | ++ | ++ |
| 1673/1674 | T334R | ++++ | ++++ | +++++ | ++++ | +++++ | + | + | + | ++ | ++ |
| 1675/1676 | T334S | ++++ | ++++ | +++++ | ++++ | +++++ | + | + | + | ++ | ++ |
| 1677/1678 | T334V | ++++ | ++++ | +++++ | ++++ | +++++ | + | ++ | ++ | ++ | +++ |
| 1679/1680 | T334W | ++++ | ++++ | ++++ | ++++ | +++++ | + | + | + | ++ | ++ |
| 1681/1682 | T334Y | ++++ | ++++ | +++++ | ++++ | +++++ | + | + | + | ++ | ++ |
| 1683/1684 | H344A | ++++ | ++++ | +++++ | ++++ | +++++ | ++ | ++ | ++ | ++ | + |
| 1685/1686 | H344C | ++++ | ++++ | +++++ | ++++ | +++++ | ++ | ++ | ++ | ++ | + |
| 1687/1688 | H344D | ++++ | ++++ | +++++ | ++++ | +++++ | ++ | ++ | ++ | ++ | ++ |
| 1689/1690 | H344E | ++++ | ++++ | +++++ | ++++ | +++++ | ++ | ++ | ++ | + | + |
| 1691/1692 | H344F | ++++ | ++++ | +++++ | ++++ | +++++ | + | ++ | + | + | + |
| 1693/1694 | H344G | ++++ | ++++ | +++++ | ++++ | +++++ | ++ | ++ | ++ | + | + |
| 1695/1696 | H344I | +++ | +++ | ++++ | ++++ | +++++ | + | + | ++ | ++ | ++ |
| 1697/1698 | H344K | ++++ | ++++ | +++++ | ++++ | +++++ | ++ | ++ | ++ | ++ | +++ |
| 1699/1700 | H344L | ++++ | ++++ | +++++ | ++++ | +++++ | ++ | ++ | ++ | ++ | + |
| 1701/1702 | H344M | ++++ | ++++ | +++++ | ++++ | +++++ | ++ | ++ | ++ | ++ | + |
| 1703/1704 | H344N | ++++ | ++++ | +++++ | +++++ | +++++ | ++ | ++ | ++ | +++ | ++ |
| 1705/1706 | H344P | ++++ | ++++ | +++++ | +++++ | +++++ | ++ | ++ | ++ | +++ | + |
| 1707/1708 | H344Q | ++++ | ++++ | +++++ | ++++ | +++++ | + | ++ | ++ | ++ | + |
| 1709/1710 | H344R | +++ | +++ | +++ | +++ | +++ | + | + | + | + | |
| 1711/1712 | H344S | ++++ | ++++ | +++++ | ++++ | +++++ | ++ | ++ | ++ | ++ | + |
| 1713/1714 | H344T | ++++ | ++++ | +++++ | ++++ | +++++ | ++ | ++ | ++ | + | + |
| 1715/1716 | H344V | ++++ | ++++ | +++++ | ++++ | +++++ | ++ | ++ | ++ | + | + |
| 1717/1718 | H344W | ++++ | ++++ | +++++ | ++++ | +++++ | ++ | ++ | ++ | ++ | + |
| 1719/1720 | H344Y | ++++ | ++++ | +++++ | ++++ | +++++ | ++ | ++ | ++ | + | + |
| 1721/1722 | F373A | +++ | ++++ | ++++ | ++++ | +++++ | + | + | + | + | + |
| 1723/1724 | F373C | +++ | ++++ | ++++ | ++++ | +++++ | ++ | ++ | + | + | + |
| 1725/1726 | F373D | +++ | +++ | + | +++ | +++ | + | + | | + | |
| 1727/1728 | F373E | +++ | ++++ | +++ | ++++ | +++++ | ++ | ++ | + | + | + |
| 1729/1730 | F373G | +++ | ++++ | + | ++++ | ++++ | + | + | | + | |
| 1731/1732 | F373H | +++ | ++++ | ++++ | +++ | +++ | ++ | + | | + | |
| 1733/1734 | F373I | +++ | ++++ | ++++ | ++++ | +++++ | ++ | ++ | + | + | + |
| 1735/1736 | F373K | +++ | +++ | +++ | +++ | ++++ | ++ | + | + | + | + |
| 1737/1738 | F373L | + | ++ | + | + | | | | | | |
| 1739/1740 | F373M | ++++ | ++++ | +++++ | ++++ | +++++ | ++ | +++ | ++ | ++ | + |
| 1741/1742 | F373N | ++++ | ++++ | +++ | ++++ | +++ | + | ++ | + | + | |
| 1743/1744 | F373P | +++ | +++ | + | +++ | +++ | + | + | | + | |
| 1745/1746 | F373Q | ++++ | ++++ | +++ | ++++ | +++ | + | ++ | + | + | + |
| 1747/1748 | F373R | ++++ | ++++ | +++ | ++++ | +++ | + | ++ | + | + | |

TABLE 5-1-continued

Lipase Activity After Various Challenge Conditions (Relative to SEQ ID NO: 2 and SEQ ID NO: 868)[1]

| SEQ ID NO: (nt/aa) | Amino Acid Substitutions[2] | Exp. #1[3] | Exp. #2[4] | Exp. #3[5] | Exp. #4[6] | Exp. #5[7] | Exp. #6[8] | Exp. #7[9] | Exp. #8[10] | Exp. #9[11] | Exp. #10[12] |
|---|---|---|---|---|---|---|---|---|---|---|---|
| 1749/1750 | F373S | ++++ | ++++ | +++ | +++ | +++ | + | ++ | + | + | |
| 1751/1752 | F373T | ++++ | ++++ | ++++ | ++++ | +++++ | + | +++ | + | + | + |
| 1753/1754 | F373V | ++++ | ++++ | ++++ | ++++ | +++++ | + | +++ | + | + | + |
| 1755/1756 | F373W | ++++ | ++++ | +++++ | ++++ | +++++ | ++ | +++ | + | + | + |
| 1757/1758 | F373Y | + | + | + | + | + | | | | | |
| 1759/1760 | P385A | +++ | ++++ | ++++ | ++++ | +++++ | + | ++ | ++ | +++ | ++ |
| 1761/1762 | P385C | ++++ | ++++ | ++++ | ++++ | +++++ | ++ | ++ | ++ | + | ++ |
| 1763/1764 | P385D | +++ | ++++ | ++++ | ++++ | +++++ | ++ | ++ | ++ | ++ | ++ |
| 1765/1766 | P385E | ++++ | ++++ | ++++ | ++++ | +++++ | ++ | ++ | ++ | ++ | ++ |
| 1767/1768 | P385F | +++ | ++++ | ++++ | ++++ | +++++ | + | + | + | + | + |
| 1769/1770 | P385G | +++ | ++++ | ++++ | ++++ | +++++ | + | ++ | + | + | + |
| 1771/1772 | P385H | +++ | ++++ | ++++ | ++++ | +++++ | ++ | ++ | ++ | + | ++ |
| 1773/1774 | P385I | +++ | ++++ | ++++ | ++++ | +++++ | + | + | + | ++ | + |
| 1775/1776 | P385K | +++ | ++++ | ++++ | ++++ | +++++ | + | ++ | ++ | ++ | + |
| 1777/1778 | P385L | +++ | ++++ | ++++ | ++++ | +++++ | + | ++ | + | + | + |
| 1779/1780 | P385M | +++ | ++++ | ++++ | ++++ | +++++ | ++ | + | + | ++ | + |
| 1781/1782 | P385N | ++++ | ++++ | ++++ | ++++ | +++++ | ++ | ++ | + | ++ | ++ |
| 1783/1784 | P385Q | +++ | ++++ | ++++ | ++++ | +++++ | ++ | ++ | + | +++ | + |
| 1785/1786 | P385R | +++ | ++++ | ++++ | ++++ | +++++ | + | + | + | ++ | + |
| 1787/1788 | P385S | +++ | ++++ | ++++ | ++++ | +++++ | ++ | + | + | ++ | + |
| 1789/1790 | P385T | +++ | ++++ | ++++ | ++++ | +++++ | + | ++ | ++ | ++ | ++ |
| 1791/1792 | P385V | ++++ | ++++ | ++++ | ++++ | +++++ | ++ | ++ | ++ | ++ | ++ |
| 1793/1794 | P385W | +++ | ++++ | ++++ | ++++ | +++++ | + | + | + | + | + |
| 1795/1796 | P385Y | +++ | ++++ | ++++ | ++++ | +++++ | + | + | + | + | + |

[1]Activities were determined relative to the reference polypeptide of SEQ ID NO: 2 and the reference polypeptide of SEQ ID NO: 868. Levels of activity are defined as follows: "+" = 0.2 to 0.9; "++" > 0.9; "+++" > 1.1; "++++" > 3; and "+++++" > 6.
[2]The amino acid differences in the variants are shown relative to SEQ ID NO: 868.
[3]In this column, the results of "Exp. #1" are shown as the FIOP when tested as described, under unchallenged conditions, with the results being relative to those of SEQ ID NO: 2.
[4]In this column, the results of "Exp. #2" are shown as the FIOP when tested as described, at 50° C., with the results being relative to those of SEQ ID NO: 2.
[5]In this column, the results of "Exp. #3" are shown as the FIOP when tested as described, in the presence of protease, with the results being relative to those of SEQ ID NO: 2.
[6]In this column, the results of "Exp. #4" are shown as the FIOP when tested as described, under gastric pH conditions of pH 5, with the results being relative to those of SEQ ID NO: 2.
[7]In this column, the results of "Exp. #5" are shown as the FIOP when tested as described, under gastric pH conditions of pH 2.5, with the results being relative to those of SEQ ID NO: 2.
[8]In this column, the results of "Exp. #6" are shown as the FIOP when tested as described, under unchallenged conditions, with the results being relative to those of SEQ ID NO: 868.
[9]In this column, the results of "Exp. #7" are shown as the FIOP when tested as described, at 50° C., with the results being relative to those of SEQ ID NO: 868.
[10]In this column, the results of "Exp. #8" are shown as the FIOP when tested as described, in the presence of protease, with the results being relative to those of SEQ ID NO: 868.
[11]In this column, the results of "Exp. #9" are shown as the FIOP when tested as described, under gastric pH conditions of pH 5, with the results being relative to those of SEQ ID NO: 868.
[12]In this column, the results of "Exp. #10" are shown as the FIOP when tested as described, under gastric pH conditions of pH 2.5, with the results being relative to those of SEQ ID NO: 868.

Example 6

Validation of a Surgical Model of Exocrine Pancreatic Insufficiency in Miniature Swine A surgical model of exocrine pancreatic insufficiency (EPI) was produced in miniature swine by pancreatic duct ligation. Starting 7 days prior to surgery and continuing throughout the experiment, female SINCLAIR™ miniature swine, aged 3-4 months, were fed a High Fat Diet (HFD; Sinclair Standard diet S-9 mixed 10:1, w/w, with BERTOLLI® olive oil) once a day. Total fecal output over 24 hours was collected on 3 consecutive days prior to surgery, and on days 15, 16, and 17 post surgery. The daily total fecal collections from each animal were prepared for subsequent analytics by adding a volume of distilled water at approximately 1.5× the fecal net weight, homogenizing, dividing into 3×50 mL aliquots, and freezing at −20° C. until analysis. The model was validated by measuring the coefficient of fat absorption (CFA; by modified Van de Kamer method; See, Van de Kamer, in Seligson (ed), *Standard Methods of Clinical Chemistry*, volume 2, Academic Press, New York, NY [1958], pp. 34-39), and coefficient of nitrogen absorption (CNA; Kjeldahl total nitrogen by Vario Max CN machine by combustion method; See, Watson et al., in Peters et al. (eds.) *Recommended Methods of Manure Analysis*, Univ. of Wisconsin Cooperative Extension Publishing, Publication No. A3769. Madison, WI. [2003], p. 18-24) in fecal samples, and assessing the percent change before and after surgery. Prior to surgery, healthy miniature swine CFA and CNA was 91.3%±1.1 SEM and 84.2%±1.2 SEM, respectively. After surgery CFA decreased by 53.2% (p<0.0001, n=11) and CNA decreased by 28.7% (p<0.0001, n=11), thus validating this surgical model for EPI studies.

Example 7

In Vivo Characterization of SEQ ID NO: 868, Compared to CREON® Pancrelipase

Validated SINCLAIR™ miniature swine surgical models of EPI (female, aged 4-5 months) were carried forward into in vivo studies to evaluate an engineered lipase variant (SEQ ID NO: 868) compared to the current standard of care (CREON® pancrelipase; AbbVie, Inc.). Starting at least 8 days prior to dosing, animals were offered HFD (Sinclair Standard S-9 diet mixed 10:1, w/w, with BERTOLLI® brand olive oil) combined with one 3.9 oz. cup of unsweetened applesauce once a day. During dosing days, the meal was prepared for each animal sequentially to ensure minimal ex vivo lipase interaction with dietary fats prior to ingestion. In brief, HFD was prepared first in a clean feed bowl. Next, enzyme (0.5 g lyophilized SEQ ID NO: 868 powder or 5.6 g of microspheres pooled from 7×36,000 U CREON® pancrelipase capsules, which corresponded to 258,000 U and 252,000 U of lipase, respectively) was mixed into a 3.9 oz. cup of unsweetened applesauce, as the acidic pH protected against early enzyme activation. Units of enzyme dosed per meal was based upon specific activity of lipase, determined by the USP lipase assay (*United States Pharmacopeia and National Formulary* (USP 42-NF 37). Rockville, MD: United Stales Pharmacopeia Convention; 2016; available at online.uspnf.com/uspnf/document/GUID-AC788D41-90A2-4F36-A6E7-769954A9ED09_1_en-US), and total calculated fat provided in the meal. The lipase-applesauce mixture was then transferred to the HFD and quickly mixed. Finally, the feed bowl was immediately offered to the animals before moving on to the next preparation. After 2 hours, the feed bowl was removed; the animals having consumed the entire meal within 30 minutes or less. A crossover design was used to maximize the number of miniature swine per group (n=3). The study incorporated an 8 day 'washout' (once daily HFD+applesauce without enzyme) between each 10-day dosing phase. Total fecal matter was collected 3 consecutive days immediately prior to dosing start and 24 hours post dosing on days 9, 10, and 11 of each phase. Fecal samples were prepared by adding a volume of distilled water at approximately 1.5× the fecal net weight to each daily total fecal collection, homogenizing, dividing into 3×50 mL and freezing at −20° C. until analysis, discarding the rest. Analytics were completed as described for model validation above. Both CREON® pancrelipase and SEQ ID NO: 868 resulted in a similar improvement in CFA to a value not significantly different than pre-surgical baseline.

Example 8

In Vivo Dose Response Characterization of SEQ ID NO: 868

Validated SINCLAIR™ miniature swine surgical models of EPI (female, aged 4-6 months) were utilized for additional in vivo SEQ ID NO: 868 dose response studies. The HFD and feeding regimen, lipase mixing protocol, fecal sample collection and preparation, and analytics were the same as described above. Compared to pre-surgical values (92.8%+/−3.2 SD, n=8), post-surgery CFA measured just prior to dosing was decreased to 39.9%+/−13.2 SD ($p<0.0001$, n=8). SEQ ID NO: 868 was dosed at 258,000 U (0.5 g lyophilized powder) to bridge with the prior study, and at 86,000 U (167 mg) and 29,000 U (55.5 mg) to assess low dose efficacy. All doses evaluated resulted in a positive effect in CFA in a dose dependent manner. From high to low dose, CFA values increased to 81.3%+/−3.9 SD ($p<0.0001$, n=3), 74%+/−3.6 SD ($p<0.0001$, n=3), and 65.5%+/−3.7 SD ($p<0.0001$, n=2), respectively, compared to predose.

All publications, patents, patent applications and other documents cited in this application are hereby incorporated by reference in their entireties for all purposes to the same extent as if each individual publication, patent, patent application or other document were individually indicated to be incorporated by reference for all purposes.

While various specific embodiments have been illustrated and described, it will be appreciated that various changes can be made without departing from the spirit and scope of the invention.

SEQUENCE LISTING (1796 sequences)

SEQ ID NO: 1 - DNA, 1161 bp, Artificial Sequence
  Wild type triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaataa

SEQ ID NO: 2 - protein, 386 aa, Artificial Sequence
  Wild type triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 3 - DNA, 1353 bp, Artificial Sequence
  Pancreatic Triacylglycerol Lipase from Homo sapiens
atgaaggaagtttgctacgagcgtctgggttgtttcagcgatgacagcccgtggagcggtatcaccgaacgtccgctgcacattttgccgtggagcccgaaagacgttaacacccgtttcctgttgtataccaacgaaaatccgaacaattttcaagaggttgctgcggatagcagcagcatcagcggtagcaacttcaagaccaatcgtaaaacccgtttcattatccatggttttattgacaagggtgaagagaactggctggctaacgtttgcaagaacttgtttaaagttgaaagcgttaactgcatctgtgttgattggaaaggtggtagccgtaccggttacacccaagctagccagaacattcgtatcgttggtgctgaagttgcgtacttcgttgagtttctgcaaagcgcgtttggttatagcccgagcaatgttcacgttattggtcattctctgggtgctcacgctgcgggtgaggcgggtcgtcgtaccaacggtaccattggtcgtatcaccggtctggacccggcggaaccgtgtttccagggtaccccggagctggttcgtttggacccgagcgatgctaagtttgttgacgttatccacaccgatggtgcgccgattgttccgaacctgggtttcggtatgagccaagttgttggtcatttggacttctttccgaatggtggtgttgaaatgccgggttgcaagaaaaacatcctgagccagattgttgatatcgacggtatttgggagggtacccgtgattttgctgcgtgtaatcacttgcgtagctacaagtactataccgacagcattgttaacccggatggtttcgctggttttccgtgcgcgagctataatgttttcaccgctaacaaatgctttccgtgtccgagcggtggttgtccgcaaatgggtcattacgcggaccgttatccgggtaaaaccaatgatgttggtcagaaattctacctggacaccggtgacgctagcaactttgcgcgttggcgttataaggttagcgttaccttgagcggtaaaaaggttaccggtcacatcctggttagcttgttcggtaacaagggtaatagcaagcaatacgaaatttttaagggtaccctgaaaccggacagcacccatagcaatgagttcgatagcgacgttgatgttggtgacctgcaaatggttaagttcatttggtacaacaacgttattaacccgaccttgccgcgtgttggtgctagcaagattatcgttgaaaccaatgttggtaaacagttcaacttttgcagcccggagaccgttcgtgaagaggttctgttgaccttgaccccgtgttaa

SEQ ID NO: 4 - protein, 450 aa, Artificial Sequence
  Pancreatic Triacylglycerol Lipase from Homo sapiens
MKEVCYERLGCFSDDSPWSGITERPLHILPWSPKDVNTRFLLYTNENPNNFQEVAADSSSISGSNFKTNRKTRFIIHGFIDKGEENWLANVCKNLFKVESVNCICVDWKGGSRTGYTQASQNIRIVGAEVAYFVEFLQSAFGYSPSNVHVIGHSLGAHAAGEAGRRTNGTIGRITGLDPAEPCFQGTPELVRLDPSDAKFVDVIHTDGAPIVPNLGFGMSQVVGHLDFFPNGGVEMPGCKKNILSQIVDIDGIWEGTRDFAACNHLRSYKYYTDSIVNPDGFAGFPCASYNVFTANKCFPCPSGGCPQMGHYADRYPGKTNDVGQKFYLDTGDASNFARWRYKVSVTLSGKKVTGHILVSLFGNKGNSKQYEIFKGTLKPDSTHSNEFDSDVDVGDLQMVKFIWYNNVINPTLPRVGASKIIVETNVGKQFNFCSPETVREEVLLTLTPC

SEQ ID NO: 5 - DNA, 1353 bp, Artificial Sequence
  Pancreatic Triacylglycerol Lipase from Panthera tigris altaica
atgaaggaagtttgcttcccgcgtctgggttgttttagcgatgacgctccgtgggcgggtatcgttcaacgtccgctgaagattttgccgtgggctccgaaagacgttaacacccgtttcctgttgtacaccaacgagaatccggataattttcaggaattgaccgctgacgcgagcattatcaccgatagcaacttcaagaccaatcgtaaaacccgtttcattatccacggttttatcgacaagggtgaagagagctggctggcgaacatttgcaaaaatttgtttaccgttgagagcgttaactgcatctgtgttgattggaagagcggtagccgtaccggttatacccaagctagccagaatattcgtatcgttggtgctgaggttgcgtacttcgttgaagttctgaaaagcgcgttgggttatagcccgagcaacgttcacattatcggtcatagcctgggtagccatgctgcgggtgaagctggtcgtcgtaccaatggtaccgttggtcgtatcaccggtttggacccggcggaaccgtgtttcgagggtaccccggaactggttcgtttggacccgagcgatgctcaatttgttgacgttattcacaccgatgctgcgccgattatcccgaacatgggtttcggtatgagccagaatgttggtcatctggatttctttccgaacggtggtaaagagatgccgggttgccaaaagaacatcttgagccagattgttgatatcgacggtatttgggaaggtacccgtgactttgttgcgtgtaaccacctgcgtagctacaagtactatagcgatagcattttgaatccgaccggtttcgctggttttccgtgcgcgagctatagcgttttcaccgctaacaagtgctttccgtgtccgagcgagggttgtccgcaaatgggtcattacgcggaccgttttagcggtaaaaccaacggtgttaatcaggttttctacctgaacaccggtgacgctagcgattttgcgcgttggcgttataaggttgctgttaccttgagcggtaaaaaggttaccggtcacgttctggttagcttgttcggtaacaagggtaatagcaaacaatacgagattttcaagggtaccctgcaggcggacaacacccatagcaatgaatttgatagcgacgttgatgttggtgacctgcaaaaggttaagttcatttggtacaacaacgttattaacccgaccttgccgcgtgttggtgctagcaaaatcgttgttgaacgtaacgacggtattagcttcaatttttgcagccaggagaccgttcgtgaagatgttctgttgaccctgaccccgtgttaa

SEQ ID NO: 6 - protein, 450 aa, Artificial Sequence
  Pancreatic Triacylglycerol Lipase from Panthera tigris altaica
MKEVCFPRLGCFSDDAPWAGIVQRPLKILPWAPKDVNTRFLLYTNENPDNFQELTADASIITDSNFKTNRKTRFIIHGFIDKGEESWLANICKNLFTVESVNCICVDWKSGSRTGYTQASQNIRIVGAEVAYFVEVLKSALGYSPSNVHIIGHSLGSHAAGEAGRRTNGTVGRITGLDPAEPCFEGTPELVRLDPSDAQFVDVIHTDAAPIIPNMGFGMSQNVGHLDFFPNGGKEMPGCQKNILSQIVDIDGIWEGTRDFVACNHLRSYKYYSDSILNPTGFAGFPCASYSVFTANKCFPCPSEGCPQMGHYADRFSGKTNGVNQVFYLNTGDASDFARWRYKVAVTLSGKKVTGHVLVSLFGNKGNSKQYEIFKGTLQADNTHSNEFDSDVDVGDLQKVKFIWYNNVINPTLPRVGASKIVVERNDGISFNFCSQETVREDVLLTLTPC

SEQ ID NO: 7 - DNA, 1362 bp, Artificial Sequence
  Pancreatic Lipase-Related Protein 2 from Homo sapiens
atgaaagaagtttgctatggtcaactgggttgtttcagcgatgagaagccgtgggctggtaccttgcagcgtccggttaaactgttgccgtggagcccggaagatatcgacacccgtttcctgttgtacaccaacgagaatccgaacaattttcaactgatcaccggtaccgaaccggataccattgaggctagcaacttccagctggaccgtaagacccgtttcattatccacggtttcctggataaagcggaagacagctggccgagcgatatgtgcaagaaaatgtttgaagttgagaaggttaactgcatttgtgttgactggcgtcatggtagccgtgctatgtacacccaagcggttcagaatatccgtgttgttggtgctgagaccgcgtttctgattcaagctctgagcacccagctgggttatagcttggaagatgttcacgttatcggtcattctttgggtgctcacaccgctgcggaggcgggtcgtcgtctgggtggtcgtgttggtcgtattaccggtctggacccggctggtccgtgtttccaagacgaaccggaagaagttcgtctggacccgagcgacgcggtttttgttgatgttatccacaccgacagcagcccgattgttccgagcctgggtttcggtatgagccagaaggttggtcatttggacttctttccgaacggtggtaaagagatgccgggttgcaagaaaaatgttctgagcaccattaccgatatcgacggtatttgggaaggtatcggtggtttcgttagctgtaaccacttgcgtagctttgagtactacagcagcagcgttctgaatccggatggtttcctgggttacccgtgcgctagctatgacgaatttcaagagagcaagtgctttccgtgtccggcggaaggttgtccgaaaatgggtcattacgctgatcaattcaagggtaaaaccagcgcggttgaacagaccttctttctgaacaccggcgagagcggtaattttaccagctggcgttataaggttagcgttaccctgagcggtaaagagaaagttaacggttacattcgtatcgctttgtatggtagcaacgaaaatagcaaacaatacgagattttcaagggtagcctgaaaccggacgctagccatacctgcgcgatcgatgttgacttcaacgttggtaaaatccagaaggttaagttcttgtggaacaagcgtggtatcaatctgagcgaaccgaaattgggtgcgagccaaattaccgttcagagcggtgaagatggtaccgagtacaacttttgcagcagcgacaccgttgaagagaatgttctgcagagcttgtatccgtgttaa

SEQ ID NO: 8 - protein, 453 aa, Artificial Sequence
  Pancreatic Lipase-Related Protein 2 from Homo sapiens
MKEVCYGQLGCFSDEKPWAGTLQRPVKLLPWSPEDIDTRFLLYTNENPNNFQLITGTEPDTIEASNFQLDRKTRFIIHGFLDKAEDSWPSDMCKKMFEVEKVNCICVDWRHGSRAMYTQAVQNIRVVGAETAFLIQALSTQLGYSLEDVHVIGHSLGAHTAAEAGRRLGGRVGRITGLDPAGPCFQDEPEEVRLDPSDAVFVDVIHTDSSPIVPSLGFGMSQKVGHLDFFPNGGKEMPGCKKNVLSTITDIDGIWEGIGGFVSCNHLRSFEYYSSSVLNPDGFLGYPCASYDEFQESKCFPCPAEGCPKMGHYADQFKGKTSAVEQTFFLNTGESGNFTSWRYKVSVTLSGKEKVNGYIRIALYGSNENSKQYEIFKGSLKPDASHTCAIDVDFNVGKIQKVKFLWNKRGINLSEPKLGASQITVQSGEDGTEYNFCSSDTVEENVLQSLYPC

SEQ ID NO: 9 - DNA, 1143 bp, Artificial Sequence
  Gastric lipase from Canis lupus familiaris
atgttgttcggtaaactgcacccgaccaacccggaagttaccatgaatatcagccaaatgattacctactggggttatccggctgaagagtacgaagttgttaccgaggacggttatattctgggtatcgatcgtattccgtacggtcgtaagaacagcgagaatatcggtcgtcgtccggttgcgttcctgcagcatggtctgttggctagcgcgaccaactggatcagcaatttgccgaacaatagcttggcttttattctggctgatgcgggttatgacgtttggctgggtaacagccgtggtaatacctgggcgcgtcgtaacttgtactatagcccggacagcgttgaattttgggctttcagctttgatgagatggcgaaatacgacttgccggctaccatcgattttattctgaagaaaaccggtcaggataagttgcactatgttggtcatagccagggtaccaccatcggtttcattgcgtttagcaccaacccgaagctggctaaacgtattaagaccttctacgctttggcgccggttgcgaccgttaaatataccgaaaccctgttgaacaagttgatgctggttccgagcttcttgtttaaactgatcttcggtaataagattttctacccgcaccatttctttgaccaatttctggcgaccgaagtttgcagccgtgagaccgttgatctgctgtgcagcaacgctctgttcattatctgtggttttgacaccatgaacttgaatatgagccgtttggatgtttacctgagccacaacccggctggtaccagcgttcaaaatgttctgcattggagccaggcggttaaaagcggtaaattccaggcttttgactggggtagcccggttcaaaacatgatgcactatcatcagagcatgccgccatactataatctgaccgatatgcacgttccgatcgcggtttggaacggtggtaatgatctgctggctgacccgcatgatgttgacctgttgctgagcaaattgccgaacctgatctaccaccgtaagattccgccgtataatcatctggactttatctgggctatggatgcgccgcaagctgtttacaacgagattgttagcatgatgggtaccgacaacaagtaa

SEQ ID NO: 10 - protein, 380 aa, Artificial Sequence
  Gastric lipase from Canis lupus familiaris
MLFGKLHPTNPEVTMNISQMITYWGYPAEEYEVVTEDGYILGIDRIPYGRKNSENIGRRPVAFLQHGLLASATNWISNLPNNSLAFILADAGYDVWLGNSRGNTWARRNLYYSPDSVEFWAFSFDEMAKYDLPATIDFILKKTGQDKLHYVGHSQGTTIGFIAFSTNPKLAKRIKTFYALAPVATVKYTETLLNKLMLVPSFLFKLIFGNKIFYPHHFFDQFLATEVCSRETVDLLCSNALFIICGFDTMNLNMSRLDVYLSHNPAGTSVQNVLHWSQAVKSGKFQAFDWGSPVQNMMHYHQSMPPYYNLTDMHVPIAVWNGGNDLLADPHDVDLLLSKLPNLIYHRKIPPYNHLDFIWAMDAPQAVYNEIVSMMGTDNK

SEQ ID NO: 11 - DNA, 1143 bp, Artificial Sequence
  Gastric lipase from Leptonychotes weddellii
atgtacttcggtaaactgcacccgatcagcccggaagttaccatgaacatcagccaaatgattacctactggggttatccgagcgaagagtacgatgttgttaccgaagacggttatattctgggtatcaatcgtattccgtacggtaaaaagaacagcgagaatattggtcgtcgtccggttgctttcctgcagcatggtctgttggctagcgcgaccaactggatcgctaatttgccgaacaatagcttggcgtttattctggctgatgcgggttacgacgtttggctgggtaacagccgtggtaatacctgggctcgtcgtaacttgtatttcagcccggacagcgttgaattttgggcgttcagctttgatgagatggctaaatacgacttgccggcgaccatcgatttcattctgaagaaaaccggtcaggataagttgcactatgttggtcatagccagggtaccaccatcggtttcattgcttttagcaccaacccgaagctggcgaaacgtatcaagaccttttacgctttggcgccggttgctaccgttaaatataccaagagcctgttgaacaagctggcgctggttccgagcttcttgtttaaactgatcttcggtgacaagattttctttccgcaccaattctttgaacagtttctggctaccgaagtttgcagccgtgagaccgttgctctgttgtgcagcaacgcgctgttcattatctgtggttttgacaccaagaacttgaatgttagccgtttggatgtttacctgagccacaatccggctggtaccagcgttcaagacgttctgcattggagccaggcggttaaaagcggtaaattccaggctttcgattggggtagcccggcgcaaaacatgctgcactatcatcagccgaccccgccgtactataatttgaccgacatgcatgttccgatcgctgtttggaacggtggtaatgatctgctggcggacccgcaagatgttgacctgttgctgagcaaattgccgaacctgatctaccacaagaaaattccgccgtataatcatctggactttatttgggctatggatgcgccgcaggttatctacaacgatattgttagcatgatgggcgagaacaataagtaa

SEQ ID NO: 12 - protein, 380 aa, Artificial Sequence
  Gastric lipase from Leptonychotes weddellii
MYFGKLHPISPEVTMNISQMITYWGYPSEEYDVVTEDGYILGINRIPYGKKNSENIGRRPVAFLQHGLLASATNWIANLPNNSLAFILADAGYDVWLGNSRGNTWARRNLYFSPDSVEFWAFSFDEMAKYDLPATIDFILKKTGQDKLHYVGHSQGTTIGFIAFSTNPKLAKRIKTFYALAPVATVKYTKSLLNKLALVPSFLFKLIFGDKIFFPHQFFEQFLATEVCSRETVALLCSNALFIICGFDTKNLNVSRLDVYLSHNPAGTSVQDVLHWSQAVKSGKFQAFDWGSPAQNMLHYHQPTPPYYNLTDMHVPIAVWNGGNDLLADPQDVDLLLSKLPNLIYHKKIPPYNHLDFIWAMDAPQVIYNDIVSMMGENNK

SEQ ID NO: 13 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaaaggcagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 14 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQRQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 15 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtgagtacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 16 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGEYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 17 - DNA, 1161 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggtgtccgttactggggtggtctgaaagacatcgagttttatttgaaccaaaccggtcataccacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctatggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcactggtggtaaaaactgggttcacagcgttaccagcttggctaccccgcataatggtagcacctttgcggatcaagaacagattgttagcttcatcaaggacttcattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgcctaaataa

SEQ ID NO: 18 - protein, 386 aa, Artificial Sequence
  Variant of triacylglycerol lipase from Bacillus thermoamylovorans
METSGNDYPIVLVHGLGGWGKGEFLGVRYWGGLKDIEFYLNQTGHTTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 19 - DNA, 1161 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggtgtccgttactggggtggtctgaaagacatcgagttttatttgaaccaaaccggtcatcgtacctacgttgctaccgttggtccggttagcagcaattgggatcgtgcggttgaattgtactattacattaatggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtatgtaagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgcctaaataa

SEQ ID NO: 20 - protein, 386 aa, Artificial Sequence
  Variant of triacylglycerol lipase from Bacillus thermoamylovorans
METSGNDYPIVLVHGLGGWGKGEFLGVRYWGGLKDIEFYLNQTGHRTYVATVGPVSSNWDRAVELYYYINGGTVDYGAAHAKEHGHARFGRTYPGIYGQWDETNKIHLIGHSMGGQTSRMLVELLKSGSQKEQEYVSQHPEEGISPLFTGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 21 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccattgttacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 22 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHCYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 23 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggtgtccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtatgtaagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctatttatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgcctaaa

SEQ ID NO: 24 - protein, 386 aa, Artificial Sequence
  Variant of triacylglycerol lipase from Bacillus thermoamylovorans
METSGNDYPIVLVHGLGGWGKGEFLGVRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYVSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAIYPFGHPNSPYDGAIKQGVWNSFPVMEGWDHMDFINFIGSNTPGYFSIYGYYNDVANRVHSLPK

SEQ ID NO: 25 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaaggtattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 26 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEGIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 27 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcgcgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 28 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISALFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 29 - DNA, 1161 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtgtaaataa

SEQ ID NO: 30 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLCK

SEQ ID NO: 31 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttcattgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 32 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFIAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 33 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctatggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcactggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgcctaaa

SEQ ID NO: 34 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 35 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtaccgtggttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 36 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTVVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 37 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaacatcagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 38 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQHQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 39 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgcttgtgagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 40 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHACEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 41 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagtggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagacgttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 42 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGETFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 43 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatcggtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 44 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHRYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 45 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggtgtccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctatggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgagggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgttcaaa

SEQ ID NO: 46 - protein, 386 aa, Artificial Sequence
  Variant of triacylglycerol lipase from Bacillus thermoamylovorans
METSGNDYPIVLVHGLGGWGKGEFLGVRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 47 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaaatgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 48 - protein, 386 aa, Artificial Sequence
  Variant of triacylglycerol lipase from Bacillus thermoamylovorans
METSGNDYPIVLVHGLGGWGKNEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 49 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtgctaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 50 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGAKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 51 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattaagaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 52 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIKTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 53 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggcttgggctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 54 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLAWAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 55 - DNA, 1158 bp, Artificial Sequence
  Variant of triacylglycerol lipase from Bacillus thermoamylovorans
atgcataccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 56 - protein, 386 aa, Artificial Sequence
  Variant of triacylglycerol lipase from Bacillus thermoamylovorans
MHTSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 57 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccataagtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 58 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHKYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 59 - DNA, 1161 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgactaaataa

SEQ ID NO: 60 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLTK

SEQ ID NO: 61 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctattcgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 62 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYSGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 63 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattaggaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 64 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIRTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 65 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggtgtccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctatggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgagggtggtaaaaactgggttcacagcgttaccagcttggctaccccgcataatggtagcacctttgcggatcaagaacagattgttagcttcatcaaggacttcattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgcggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaaatatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgcctaaa

SEQ ID NO: 66 - protein, 386 aa, Artificial Sequence
  Variant of triacylglycerol lipase from Bacillus thermoamylovorans
METSGNDYPIVLVHGLGGWGKGEFLGVRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 67 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtattgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 68 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGIVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 69 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgttgtccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 70 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRCPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 71 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 72 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLAAAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 73 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtgcgagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 74 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRASPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 75 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtgatagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 76 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRDSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 77 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgaggcgtatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 78 - protein, 386 aa, Artificial Sequence
  Variant of triacylglycerol lipase from Bacillus thermoamylovorans
METSGNDYPIVLVHGLGGWGKGEFLGYRYWGGLKDIEAYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 79 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtttgaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 80 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGLKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 81 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttcatggcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 82 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFMAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 83 - DNA, 1161 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgcggaaataa

SEQ ID NO: 84 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLRK

SEQ ID NO: 85 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtcgttacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 86 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 87 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagctttctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 88 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISFLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 89 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaacttggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 90 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPELGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 91 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtgcgggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 92 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARAGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 93 - DNA, 1161 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaataa

SEQ ID NO: 94 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 95 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagaggttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattatccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 96 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGERFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 97 - DNA, 1161 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcataccacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgagggtggtaaaaactgggttcacagcgttaccagcttggctaccccgcataatggtagcacctttgcggatcaagaacagattgttagcttcatcaaggacctgattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgcctaaataa

SEQ ID NO: 98 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHTTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDLIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 99 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtgggccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 100 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRGPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 101 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaggagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 102 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMRSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 103 - DNA, 1158 bp, Artificial Sequence
  Variant of triacylglycerol lipase from Bacillus thermoamylovorans
atggagtcgagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 104 - protein, 386 aa, Artificial Sequence
  Variant of triacylglycerol lipase from Bacillus thermoamylovorans
MESSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 105 - DNA, 1158 bp, Artificial Sequence
  Variant of triacylglycerol lipase from Bacillus thermoamylovorans
atggagcgtagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 106 - protein, 386 aa, Artificial Sequence
  Variant of triacylglycerol lipase from Bacillus thermoamylovorans
MERSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 107 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaaattggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 108 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEIGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 109 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttccggggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 110 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFRGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 111 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagctcgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 112 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISSLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 113 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctctggagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 114 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHALEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 115 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggttgtgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccgattattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 116 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGCVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPIIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 117 - DNA, 1158 bp, Artificial Sequence
  Variant of triacylglycerol lipase from Bacillus thermoamylovorans
atggagacctggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 118 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 119 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtacgggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 120 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARTGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 121 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtcttacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 122 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQESYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 123 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacattcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 124 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHIHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 125 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctgaagagcacggtcatgcgcgtttcggtcgtacctattcgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacaaattgtttcgttcatcaaggactttattatccacctggctagcgctgcgggtcaaaaacaggagagcttgctgtatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgtttggtcatccgaatagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 126 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAEEHGHARFGRTYSGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLLYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 127 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctatggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggacttcattatccacctggctagcgctgcgggtcaaaaagatgagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgcctaaa

SEQ ID NO: 128 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKDESLIYDFKLDQWGLKRQPGESFHAYMNRVMTSPIWESNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 129 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccgagtgagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 130 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPSEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 131 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctgaggagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 132 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAEEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 133 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggaggtgtacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 134 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEVYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 135 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcgtgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 136 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISVQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 137 - DNA, 1158 bp, Artificial Sequence
  Variant of triacylglycerol lipase from Bacillus thermoamylovorans
atggaggcgagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 138 - protein, 386 aa, Artificial Sequence
  Variant of triacylglycerol lipase from Bacillus thermoamylovorans
MEASGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 139 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggttcgtacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 140 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGSYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 141 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaaaggattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 142 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQERIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 143 - DNA, 1161 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgagggtggtaaaaactgggttcacagcgttaccagcttggctaccccgcataatggtagcacctttgcggatcaagaacagattgttagcttcatcaaggacttcattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgcctaaataa

SEQ ID NO: 144 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 145 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccgtttgagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 146 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPFEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 147 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcttgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 148 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISLQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 149 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaatggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 150 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYINGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 151 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgcttttgagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 152 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAFEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 153 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatacggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 154 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHTEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 155 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttcggttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 156 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVRFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 157 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcataggcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 158 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHRRFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 159 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgctgtatgatttcaagctggaccaatggggtttgaaacgtcagccaggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 160 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLLYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 161 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtaattacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 162 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGNYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 163 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtattaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 164 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGIKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 165 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtacgccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 166 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRTPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 167 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtcgtgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 168 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGRVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 169 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaatttggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 170 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEFGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 171 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgtatagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 172 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPYSPYDGAIKQGVWNSFPVMEGWDHMDFINFIGSNTPGYFSIYGYYNDVANRVHSLFK

SEQ ID NO: 173 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcactggcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 174 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHWHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 175 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttcggggcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 176 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFGAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 177 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagcagtacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 178 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEQYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 179 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaacacgtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 180 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNTWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 181 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagctttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 182 - protein, 386 aa, Artificial Sequence
  Variant of triacylglycerol lipase from Bacillus thermoamylovorans
METSGNDYPIVLVHGLGGWGKGEFLGYRYWGGLKDIELYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 183 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagcatggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 184 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQHGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 185 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttcactgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 186 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFTAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 187 - DNA, 1161 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggacctgattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgcctaaataa

SEQ ID NO: 188 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDLIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 189 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagctatctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 190 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISYLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 191 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgttggggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 192 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARWGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 193 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtgttggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 194 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARVGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 195 - DNA, 1158 bp, Artificial Sequence
  Variant of triacylglycerol lipase from Bacillus thermoamylovorans
atgatgaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 196 - protein, 386 aa, Artificial Sequence
  Variant of triacylglycerol lipase from Bacillus thermoamylovorans
MMTSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 197 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatccatgactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 198 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIHDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 199 - DNA, 1158 bp, Artificial Sequence
  Variant of triacylglycerol lipase from Bacillus thermoamylovorans
atggaggggagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 200 - protein, 386 aa, Artificial Sequence
  Variant of triacylglycerol lipase from Bacillus thermoamylovorans
MEGSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 201 - DNA, 1161 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctggataaataa

SEQ ID NO: 202 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLDK

SEQ ID NO: 203 - DNA, 1161 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggtgtccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgcggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgcctaaataa

SEQ ID NO: 204 - protein, 386 aa, Artificial Sequence
  Variant of triacylglycerol lipase from Bacillus thermoamylovorans
METSGNDYPIVLVHGLGGWGKGEFLGVRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 205 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagggcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 206 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKGHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 207 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatttatgatttcaagctggaccaatggggtttgaaacgtcaggcaggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgtttggtcatccgactagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 208 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQAGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPTSPYDGAIKQGVWNSFPVMEGWDHMDFINFIGSNTPGYFSIYGYYNDVANRVHSLFK

SEQ ID NO: 209 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtatgagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 210 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGMSPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 211 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggcggagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 212 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPAEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 213 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggtgtccgttactggggtggtctgaaagacatcgagttttatttgaaccaaaccggtcataccacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatcgccggtcaatgggatgaaaccaataagattcacctgatcggtcatagcatgggtggtcagaccagccgtatgttggttgagctgttgaagagcggtagccaaaaagaacaggagtatgtaagccaacatccggaagagggtattagcccgctgttcgagggtggtaaaaactgggttcacagcgttaccagcttggctaccccgcataatggtagcacctttgcggatcaagaacagattgttagcttcatcaaggacttcattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgcggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgcctaaa

SEQ ID NO: 214 - protein, 386 aa, Artificial Sequence
  Variant of triacylglycerol lipase from Bacillus thermoamylovorans
METSGNDYPIVLVHGLGGWGKGEFLGVRYWGGLKDIEFYLNQTGHTTYVATVGPVSSNWDRAVELYYYIKGGTVDYGAAHAKEHGHARFGRTYPGIAGQWDETNKIHLIGHSMGGQTSRMLVELLKSGSQKEQEYVSQHPEEGISPLFEGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 215 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcgctcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 216 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISAQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 217 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccgttggagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 218 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPLEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 219 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaagggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 220 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFKGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 221 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaaaagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 222 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKKHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 223 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctggtgagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 224 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAGEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 225 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgggtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 226 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHGYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 227 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggttggagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 228 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGWSPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 229 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtcggagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 230 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGRSPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 231 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccgagcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 232 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTEHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 233 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatcgccggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgagggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgcggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgcctaaa

SEQ ID NO: 234 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIAGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 235 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagctggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 236 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEAGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 237 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagctgtcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 238 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISCQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 239 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtatgtacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 240 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGMYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 241 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtactagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 242 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRTSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 243 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagtggttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 244 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGEWFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 245 - DNA, 1161 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgagggtggtaaaaactgggttcacagcgttaccagcttggctaccccgcataatggtagcacctttgcggatcaagaacagattgttagcttcatcaaggacttcattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgcggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgttcaaataa

SEQ ID NO: 246 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 247 - DNA, 1158 bp, Artificial Sequence
  Variant of triacylglycerol lipase from Bacillus thermoamylovorans
atggagacctatggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 248 - protein, 386 aa, Artificial Sequence
  Variant of triacylglycerol lipase from Bacillus thermoamylovorans
METYGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 249 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagggttacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 250 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEGYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 251 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctatggtcaatgggatgaaaccaataagattcacctgatcggtcatagcatgggtggtcagaccagccgtatgttggttgagctgttgaagagcggtagccaaaaagaacaggagtatgtaagccaacatccggaagagggtattagcccgctgttcactggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgcctaaa

SEQ ID NO: 252 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYVSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 253 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttggtgcgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 254 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLVRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 255 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctacgcgtgttcatagcctgtttaaa

SEQ ID NO: 256 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVATRVHSLFK

SEQ ID NO: 257 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttactttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 258 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVTFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 259 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcgtccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 260 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRRPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 261 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtgcgtatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 262 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRAYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 263 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagacttacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 264 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQETYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 265 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaagttgagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 266 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKVESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 267 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgctgtatgatttcaagctggaccaatggggtttgaaacgtcaggcaggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 268 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLLYDFKLDQWGLKRQAGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 269 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagcattatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 270 - protein, 386 aa, Artificial Sequence
  Variant of triacylglycerol lipase from Bacillus thermoamylovorans
METSGNDYPIVLVHGLGGWGKGEFLGYRYWGGLKDIEHYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 271 - DNA, 1161 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctggctaaataa

SEQ ID NO: 272 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLAK

SEQ ID NO: 273 - DNA, 1158 bp, Artificial Sequence
  Variant of triacylglycerol lipase from Bacillus thermoamylovorans
atgactaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 274 - protein, 386 aa, Artificial Sequence
  Variant of triacylglycerol lipase from Bacillus thermoamylovorans
MTTSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 275 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaacggctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 276 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQRLNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 277 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcataccacctacgttgctaccgttggtccggttagcagcaattgggatcgtgcggttgaattgtactattacattaatggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcactggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 278 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHTTYVATVGPVSSNWDRAVELYYYINGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 279 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaatcaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 280 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQNQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 281 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaactcaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 282 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQTQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 283 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacttattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 284 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQELIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 285 - DNA, 1158 bp, Artificial Sequence
  Variant of triacylglycerol lipase from Bacillus thermoamylovorans
atggagaccatgggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 286 - protein, 386 aa, Artificial Sequence
  Variant of triacylglycerol lipase from Bacillus thermoamylovorans
METMGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 287 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatgctagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggctattacaacgacgttgctaatcgtgttcatagcctgtttaaa

SEQ ID NO: 288 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDASWLPNDGIVNVVSAKYPFGHPNSPYDGAIKQGVWNSFPVMEGWDHMDFINFIGSNTPGYFSIYGYYNDVANRVHSLFK

SEQ ID NO: 289 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaatcagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 290 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAINQGVWNSFPVMEGWDHMDFINFIGSNTPGYFSIYGYYNDVANRVHSLFK

SEQ ID NO: 291 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaatcaggagagcttgctgtatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 292 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQNQESLLYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 293 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttcgatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 294 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFDAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 295 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggcctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttctgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 296 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISASDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 297 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctgaagagcacggtcatgcgcgtttcggtcgtacctattcgggtatctacggtcaatggagcgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaatcaggagagcttgctgtatgatttcaagctggaccaatggggtttgaaacgtcagccaggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 298 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAEEHGHARFGRTYSGIYGQWSETNKIHLIGHSMGGQTSRMLVELLKSGSQKEQEYYSQHPEEGISPLFTGGKNWVHSVTSLATPHNGSTFADQEQIVSFIKDFIIHLASAAGQNQESLLYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 299 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttggttcaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 300 - protein, 386 aa, Artificial Sequence
  Variant of triacylglycerol lipase from Bacillus thermoamylovorans
METSGNDYPIVLVHGLGGWGKGEFLGYRYWGGLKDIEFYLVQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 301 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctacgttggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 302 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYVGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 303 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttggcgcgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 304 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLARQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 305 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctggatgacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 306 - protein, 386 aa, Artificial Sequence
  Variant of triacylglycerol lipase from Bacillus thermoamylovorans
METSGNDYPIVLVHGLGGWGKGEFLGYRYWGGLDDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 307 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttgatggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 308 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVDGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 309 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctgaggctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgtttaaa

SEQ ID NO: 310 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLAEAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLFK

SEQ ID NO: 311 - DNA, 1158 bp, Artificial Sequence
  Variant of triacylglycerol lipase from Bacillus thermoamylovorans
atggagacgtggggtaacgattatccgattgctctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtgacagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 312 - protein, 386 aa, Artificial Sequence
  Variant of triacylglycerol lipase from Bacillus thermoamylovorans
METWGNDYPIALVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISLQMGRYTRDSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 313 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtgacagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 314 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISLQMGRYTRDSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 315 - DNA, 1158 bp, Artificial Sequence
  Variant of triacylglycerol lipase from Bacillus thermoamylovorans
atggagtcgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtgaatacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcttacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtcgctacacccgtgacagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 316 - protein, 386 aa, Artificial Sequence
  Variant of triacylglycerol lipase from Bacillus thermoamylovorans
MESWGNDYPIVLVHGLGGWGKGEFLGYRYWGGLKDIEFYLNQTGHRTYVATVGPVSSNWDRAVELYYYIKGGTVDYGAAHAKEHGHARFGRTYPGEYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGRYTRDSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 317 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagcagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtgacagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 318 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRDSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 319 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtgaatacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcttacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtcgctacacccgtgacagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 320 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGEYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISMQMGRYTRDSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 321 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcactggtggtaaaaactgggttcacagcgttaccagcttggctaccccgcataatggtagcacctttgcggatcaacgccagattgttagcttcatcaaggactttattatccacctggctagcgctgcgggtcaaaaacaggagagcttgatctatgatttcaagctggaccaatggggtttgaaacgtcagccgggtgagagcttccatgcttacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 322 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQRQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 323 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccataagtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtgacagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 324 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHKYMNRVMTSPIWESNDISAYDLTTLGAQELNQWMKTYPDVYYLSYTGNASYRGVVTGNYYPIGTMHPLFTLISLQMGRYTRDSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 325 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcactggtggtaaaaactgggttcacagcgttaccagcttggctaccccgcataatggtagcacctttgcggatcaagagcagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtgacagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 326 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRDSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 327 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtcgctacacccgtgacagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 328 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGRYTRDSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 329 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtgaatacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagcagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtgacagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 330 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGEYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISLQMGRYTRDSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 331 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacaccagattgttagcttcatcaaggactttattatccacctggctagcgctgcgggtcaaaaacaggagagcttgatctatgatttcaagctggaccaatggggtttgaaacgtcagccgggtgagagcttccatgcttacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 332 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQHQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 333 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtgaatacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcactggtggtaaaaactgggttcacagcgttaccagcttggctaccccgcataatggtagcacctttgcggatcaagagcagattgttagcttcatcaaggactttattatccacctggctagcgctgcgggtcaaaaacaggagagcttgatctatgatttcaagctggaccaatggggtttgaaacgtcagccgggtgagagcttccatgcttacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtgacagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 334 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGEYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISLQMGRYTRDSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 335 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcactggtggtaaaaactgggttcacagcgttaccagcttggctaccccgcataatggtagcacctttgcggatcaacaccagattgttagcttcatcaaggactttattatccacctggctagcgctgcgggtcaaaaacaggagagcttgatctatgatttcaagctggaccaatggggtttgaaacgtcagccgggtgagagcttccataagtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 336 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQHQIVSFIKDFIIHLASAAGQKQESLIYDFKLDQWGLKRQPGESFHKYMNRVMTSPIWQSNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 337 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtgaatacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagcagattgttagcttcatcaaggactttattatccacctggctagcgctgcgggtcaaaaacaggagagcttgatctatgatttcaagctggaccaatggggtttgaaacgtcagccgggtgagagcttccatgcttacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 338 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGEYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 339 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtgaatacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcactggtggtaaaaactgggttcacagcgttaccagcttggctaccccgcataatggtagcacctttgcggatcaacaccagattgttagcttcatcaaggactttattatccacctggctagcgctgcgggtcaaaaacaggagagcttgatctatgatttcaagctggaccaatggggtttgaaacgtcagccgggtgagagcttccataagtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 340 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGEYGQWDETNKIHLIGHSMGGQTSRMLVELLKSGSQKEQEYYSQHPEEGISPLFTGGKNWVHSVTSLATPHNGSTFADQHQIVSFIKDFIIHLASAAGQKQESLIYDFKLDQWGLKRQPGESFHKYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 341 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcactggtggtaaaaactgggttcacagcgttaccagcttggctaccccgcataatggtagcacctttgcggatcaagagcagattgttagcttcatcaaggactttattatccacctggctagcgctgcgggtcaaaaacaggagagcttgatctatgatttcaagctggaccaatggggtttgaaacgtcagccgggtgagagcttccatgcttacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtcgctacacccgtgacagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 342 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISMQMGRYTRDSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 343 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtgaatacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagcagattgttagcttcatcaaggactttattatccacctggctagcgctgcgggtcaaaaacaggagagcttgatctatgatttcaagctggaccaatggggtttgaaacgtcagccgggtgagagcttccatgcttacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 344 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGEYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 345 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcttacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 346 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 347 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagagcagattgttagcttcatcaaggactttattatccacctggctagcgctgcgggtcaaaaacaggagagcttgatctatgatttcaagctggaccaatggggtttgaaacgtcagccgggtgagagcttccatgcttacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 348 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 349 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 350 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 351 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtgaatacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacaccagattgttagcttcatcaaggactttattatccacctggctagcgctgcgggtcaaaaacaggagagcttgatctatgatttcaagctggaccaatggggtttgaaacgtcagccgggtgagagcttccatgcttacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 352 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGEYGQWDETNKIHLIGHSMGGQTSRMLVELLKSGSQKEQEYYSQHPEEGISPLFEGGKNWVHSVTSLATPHNGSTFADQHQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 353 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcactggtggtaaaaactgggttcacagcgttaccagcttggctaccccgcataatggtagcacctttgcggatcaacaccagattgttagcttcatcaaggactttattatccacctggctagcgctgcgggtcaaaaacaggagagcttgatctatgatttcaagctggaccaatggggtttgaaacgtcagccgggtgagagcttccatgcttacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 354 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQHQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 355 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcactggtggtaaaaactgggttcacagcgttaccagcttggctaccccgcataatggtagcacctttgcggatcaagagcagattgttagcttcatcaaggactttattatccacctggctagcgctgcgggtcaaaaacaggagagcttgatctatgatttcaagctggaccaatggggtttgaaacgtcagccgggtgagagcttccatgcttacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtcgctacacccgtgacagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 356 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGRYTRDSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 357 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtgaatacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 358 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGEYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISMQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 359 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagcagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 360 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 361 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 362 - protein, 386 aa, Artificial Sequence; identical to SEQ ID NO: 34
  Variant of triacylglycerol lipase from Bacillus thermoamylovorans

SEQ ID NO: 363 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcactggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 364 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISMQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 365 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcttacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtgacagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 366 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISMQMGSYTRDSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 367 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacgccagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 368 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 369 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtgaatacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtcgctacacccgtgacagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 370 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGEYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISMQMGRYTRDSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 371 - DNA, 1158 bp, Artificial Sequence
  Variant of triacylglycerol lipase from Bacillus thermoamylovorans
atggagtcgtcgggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 372 - protein, 386 aa, Artificial Sequence
  Variant of triacylglycerol lipase from Bacillus thermoamylovorans
MESSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 373 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggtgttcgttactggggtggtctgaaggacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgttttggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccacgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 374 - protein, 386 aa, Artificial Sequence; identical to SEQ ID NO: 204
  Variant of triacylglycerol lipase from Bacillus thermoamylovorans

SEQ ID NO: 375 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcactggtggtaaaaactgggttcacagcgttaccagcttggctaccccgcataatggtagcacctttgcggatcaagagcagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 376 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 377 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcttacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 378 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 379 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtgaatacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcactggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccataagtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 380 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGEYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHKYMNRVMTSPIWQSNDISAYDLTTLGAQELNQWMKTYPDVYYLSYTGNASYRGVVTGNYYPIGTMHPLFTLISMQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 381 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacaccagattgttagcttcatcaaggactttattatccacctggctagcgctgcgggtcaaaaacaggagagcttgatctatgatttcaagctggaccaatggggtttgaaacgtcagccgggtgagagcttccatgcttacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtgacagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 382 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQHQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRDSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 383 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtatcgttgactacggtgctgcgcacgcttgtgagcacggtcatgcgcgttttggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccacgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 384 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGIVDYGAAHACEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 385 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaggacatcgagttttatttgaaccaaaccggtcatcgtacctacgttgctaccgttggtccggttagcagcaattgggatcgtgcggttgaattgtactattacattaagggtggtatcgttgactacggtgctgcgcacgctctggagcacggtcatgcgcgttttggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgtttcgttcatcaaggacctgattatccacctggctagcgctgcgggtcaaaaacaggagagcttgatctatgatttcaagctggaccaatggggtttgaaacgtcagccgggtgagagcttccacgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 386 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGIVDYGAAHALEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDLIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 387 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggtgttcgttactggggtggtctggatgacatcgagttttatttgaaccaaaccggtcatcgtacctacgttgctaccgttggtccggttagcagcaattgggatcgtgcggttgaattgtactattacattaagggtggtaccgttgactacggtgctgcgcacgctgaggagcacggtcatgcgcgttttggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccacgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 388 - protein, 386 aa, Artificial Sequence
  Variant of triacylglycerol lipase from Bacillus thermoamylovorans
METSGNDYPIVLVHGLGGWGKGEFLGVRYWGGLDDIEFYLNQTGHRTYVATVGPVSSNWDRAVELYYYIKGGTVDYGAAHAEEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 389 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggtgttcgttactggggtggtctgaaggacatcgagttttatttgaaccaaaccggtcatcgtacctacgttgctaccgttggtccggttagcagcaattgggatcgtgcggttgaattgtactattacattaagggtggtatcgttgactacggtgctgcgcacgctctggagcacggtcatgcgcgttttggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgtttcgttcatcaaggacttcattatccacctggctagcgctgcgggtcaaaaacaggagagcttgatctatgatttcaagctggaccaatggggtttgaaacgtcagccgggtgagagcttcatcgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 390 - protein, 386 aa, Artificial Sequence
  Variant of triacylglycerol lipase from Bacillus thermoamylovorans
METSGNDYPIVLVHGLGGWGKGEFLGVRYWGGLKDIEFYLNQTGHRTYVATVGPVSSNWDRAVELYYYIKGGIVDYGAAHALEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFIAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 391 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctggatgacatcgagttttatttgaaccaaaccggtcatcgtacctacgttgctaccgttggtccggttagcagcaattgggatcgtgcggttgaattgtactattacattaagggtggtaccgttgactacggtgctgcgcacgcttgtgagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 392 - protein, 386 aa, Artificial Sequence
  Variant of triacylglycerol lipase from Bacillus thermoamylovorans
METSGNDYPIVLVHGLGGWGKGEFLGYRYWGGLDDIEFYLNQTGHRTYVATVGPVSSNWDRAVELYYYIKGGTVDYGAAHACEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 393 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggtgttcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgttttggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttcatcgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 394 - protein, 386 aa, Artificial Sequence
  Variant of triacylglycerol lipase from Bacillus thermoamylovorans
METSGNDYPIVLVHGLGGWGKGEFLGVRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFIAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 395 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggtgttcgttactggggtggtctgaaggacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtacgggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttccgttcatcaaggacttcattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 396 - protein, 386 aa, Artificial Sequence
  Variant of triacylglycerol lipase from Bacillus thermoamylovorans
METSGNDYPIVLVHGLGGWGKGEFLGVRYWGGLKDIEFYLNQTGHRTYVATVGPVSSNWDRAVELYYYIKGGTVDYGAAHAKEHGHARTGRTYPGIYGQWDETNKIHLIGHSMGGQTSRMLVELLKSGSQKEQEYYSQHPEEGISPLFTGGKNWVHSVTSLATPHNGSTFADQEQIVPFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 397 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggtgttcgttactggggtggtctgaaggacatcgagttttatttgaaccaaaccggtcatcgtacctacgttgctaccgttggtccggttagcagcaattgggatcgtgcggttgaattgtactattacattaagggtggtatcgttgactacggtgctgcgcacgctctggagcacggtcatgcgcgttttggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggacttcattatccacctggctagcgctgcgggtcaaaaacaggagagcttgatctatgatttcaagctggaccaatggggtttgaaacgtcagccgggtgagagcttcatggcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 398 - protein, 386 aa, Artificial Sequence
  Variant of triacylglycerol lipase from Bacillus thermoamylovorans
METSGNDYPIVLVHGLGGWGKGEFLGVRYWGGLKDIEFYLNQTGHRTYVATVGPVSSNWDRAVELYYYIKGGIVDYGAAHALEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFMAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 399 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggtgttcgttactggggtggtctgaaggacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtacgggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgtttcgttcatcaaggacttcattatccacctggctagcgctgcgggtcaaaaacaggagagcttgatctatgatttcaagctggaccaatggggtttgaaacgtcagccgggtgagagcttccacgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 400 - protein, 386 aa, Artificial Sequence
  Variant of triacylglycerol lipase from Bacillus thermoamylovorans
METSGNDYPIVLVHGLGGWGKGEFLGVRYWGGLKDIEFYLNQTGHRTYVATVGPVSSNWDRAVELYYYIKGGTVDYGAAHAKEHGHARTGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 401 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctattcgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcttcctgttcaccggtggtaaaaactgggttcacagcgttaccagcttggctaccccgcataatggtagcacctttgcggatcaagaagggattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 402 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYSGIYGQWDETNKIHLIGHSMGGQTSRMLVELLKSGSQKEQEYYSQHPEEGISFLFTGGKNWVHSVTSLATPHNGSTFADQEGIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 403 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggtgttcgttactggggtggtctgaaggacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtacgggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttcatcgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 404 - protein, 386 aa, Artificial Sequence
  Variant of triacylglycerol lipase from Bacillus thermoamylovorans
METSGNDYPIVLVHGLGGWGKGEFLGVRYWGGLKDIEFYLNQTGHRTYVATVGPVSSNWDRAVELYYYIKGGTVDYGAAHAKEHGHARTGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFIAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 405 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaggacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttcatcgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 406 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFIAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 407 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctggatgacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgttttggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttcatggcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 408 - protein, 386 aa, Artificial Sequence
  Variant of triacylglycerol lipase from Bacillus thermoamylovorans
METSGNDYPIVLVHGLGGWGKGEFLGYRYWGGLDDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFMAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 409 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctggatgacatcgagttttatttgaaccaaaccggtcatcgtacctacgttgctaccgttggtccggttagcagcaattgggatcgtgcggttgaattgtactattacattaagggtggtatcgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaccggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttcatcgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 410 - protein, 386 aa, Artificial Sequence
  Variant of triacylglycerol lipase from Bacillus thermoamylovorans
METSGNDYPIVLVHGLGGWGKGEFLGYRYWGGLDDIEFYLNQTGHRTYVATVGPVSSNWDRAVELYYYIKGGIVDYGAAHAKEHGHARFGRTYPGIYGQWDETNKIHLIGHSMGGQTSRMLVELLKSGSQKEQEYYSQHPEEGISPLFTGGKNWVHSVTSLATPHNGSTFADQEQIVSFIKDFIIHLASAAGQKQESLIYDFKLDQWGLKRQPGESFIAYMNRVMTSPIWQSNDISAYDLTTLGAQELNQWMKTYPDVYYLSYTGNASYRGVVTGNYYPIGTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 411 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatctacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagctttctgttcaccggtggtaaaaactgggttcacagcgttaccagcttggctaccccgcataatggtagcacctttgcggatcaagaagggattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattaaaaccatgcacccgctgtttaccttgatcagcatgcaaatgggtagctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 412 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISFLFTGGKNWVHSVTSLATPHNGSTFADQEGIVSFIKDFIIHLAAAAGQKQESLIYDFKLDQWGLKRQPGESFHAYMNRVMTSPIWQSNDISAYDLTTLGAQELNQWMKTYPDVYYLSYTGNASYRGVVTGNYYPIKTMHPLFTLISMQMGSYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 413 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccacctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 414 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPPPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 415 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgatgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 416 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 417 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccacctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 418 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPPPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 419 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtgattgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 420 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGDWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 421 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggttataaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 422 - protein, 386 aa, Artificial Sequence
  Variant of triacylglycerol lipase from Bacillus thermoamylovorans
METSGNDYPIVLVHGLGGWGKGEFLGYRYWGGYKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 423 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 424 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 425 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccacccggggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 426 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTRGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 427 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaaaagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 428 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKKGVWNSFPVMEGWDHMDFINFIGSNTPGYFSIYGYYNDVANRVHSLPK

SEQ ID NO: 429 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacagcggtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 430 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQRYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 431 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggggttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 432 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 433 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatacgagcatctacggttattacaacgacgttgctaatcgtgttcatagcctgccgaaa

SEQ ID NO: 434 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYTSIYGYYNDVANRVHSLPK

SEQ ID NO: 435 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagctgggatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 436 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESWDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 437 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccaggggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 438 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTRGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 439 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacacctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 440 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQHLIVSFIKDFIIHLAAAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 441 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 442 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 443 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggtgtgcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgcttgcgagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacacggcattgttagcttcatcaaggactttattatccacctggctgcggctgcgggtcaaaaacaggagagcttgatctatgatttcaagctggaccaatggggtttgaaacgtcagccgggtgagagcttcatggcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtgatagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcaacatctacggtttttacaacgacgttgctaatcgtgttcatagcctgccgaaa

SEQ ID NO: 444 - protein, 386 aa, Artificial Sequence
  Variant of triacylglycerol lipase from Bacillus thermoamylovorans
METSGNDYPIVLVHGLGGWGKGEFLGVRYWGGLKDIEFYLNQTGHRTYVATVGPVSSNWDRAVELYYYIKGGTVDYGAAHACEHGHARFGRTYPGIYGQWDETNKIHLIGHSMGGQTSRMLVELLKSGSQKEQEYYSQHPEEGISPLFEGGKNWVHSVTSLATPHNGSTFADQHGIVSFIKDFIIHLAAAAGQKQESLIYDFKLDQWGLKRQPGESFMAYMNRVMTSPIWESNDISAYDLTTLGAQELNQWMKTYPDVYYLSYTGNASYRGVVTGNYYPIGTMHPLFTLISLQMGRYTRDSPAPVIDRSWLPNDGIVNVVSAKYPFGHPNSPYDGAIKQGVWNSFPVMEGWDHMDFINFIGSNTPGYFNIYGFYNDVANRVHSLPK

SEQ ID NO: 445 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagggcattgttagcttcatcaaggactttattatccacctggcttcggctgcgggtcaaaaacaggagagcttgatctatgatttcaagctggaccaatggggtttgaaacgtcagccgggtgagagcttcatggcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 446 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEGIVSFIKDFIIHLASAAGQKQESLIYDFKLDQWGLKRQPGESFMAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 447 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatgcgagcatctacggttattacaacgacgttgctaatcgtgttcatagcctgccgaaa

SEQ ID NO: 448 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYASIYGYYNDVANRVHSLPK

SEQ ID NO: 449 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagggcattgttagcttcatcaaggactttattatccacctggctgcggctgcgggtcaaaaacaggagagcttgatctatgatttcaagctggaccaatggggtttgaaacgtcagccgggtgagagcttcatggcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtgatagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 450 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEGIVSFIKDFIIHLAAAAGQKQESLIYDFKLDQWGLKRQPGESFMAYMNRVMTSPIWESNDISAYDLTTLGAQELNQWMKTYPDVYYLSYTGNASYRGVVTGNYYPIGTMHPLFTLISLQMGRYTRDSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 451 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagggcattgttagcttcatcaaggactttattatccacctggctagcgctgcgggtcaaaaacaggagagcttgatctatgatttcaagctggaccaatggggtttgaaacgtcagccgggtgagagcttcatggcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 452 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEGIVSFIKDFIIHLASAAGQKQESLIYDFKLDQWGLKRQPGESFMAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 453 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaagggtgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 454 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKGWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 455 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggtgtgcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgcttgcgagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacacggcattgttagcttcatcaaggactttattatccacctggcttcggctgcgggtcaaaaacaggagagcttgatctatgatttcaagctggaccaatggggtttgaaacgtcagccgggtgagagcttcatggcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtgatagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcaacatctacggttattacaacgacgttgctaatcgtgttcatagcctgccgaaa

SEQ ID NO: 456 - protein, 386 aa, Artificial Sequence
  Variant of triacylglycerol lipase from Bacillus thermoamylovorans
METSGNDYPIVLVHGLGGWGKGEFLGVRYWGGLKDIEFYLNQTGHRTYVATVGPVSSNWDRAVELYYYIKGGTVDYGAAHACEHGHARFGRTYPGIYGQWDETNKIHLIGHSMGGQTSRMLVELLKSGSQKEQEYYSQHPEEGISPLFEGGKNWVHSVTSLATPHNGSTFADQHGIVSFIKDFIIHLASAAGQKQESLIYDFKLDQWGLKRQPGESFMAYMNRVMTSPIWESNDISAYDLTTLGAQELNQWMKTYPDVYYLSYTGNASYRGVVTGNYYPIGTMHPLFTLISLQMGRYTRDSPAPVIDRSWLPNDGIVNVVSAKYPFGHPNSPYDGAIKQGVWNSFPVMEGWDHMDFINFIGSNTPGYFNIYGYYNDVANRVHSLPK

SEQ ID NO: 457 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttggcagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 458 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWQSNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 459 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacaccagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 460 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQHQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 461 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagggcattgttagcttcatcaaggactttattatccacctggctgcggctgcgggtcaaaaacaggagagcttgatctatgatttcaagctggaccaatggggtttgaaacgtcagccgggtgagagcttcatggcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 462 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEGIVSFIKDFIIHLAAAAGQKQESLIYDFKLDQWGLKRQPGESFMAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 463 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaacccataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 464 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETHKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 465 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 466 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYTGAIKQGVWNSFPVMEGWDHMDFINFIGSNTPGYFSIYGYYNDVANRVHSLPK

SEQ ID NO: 467 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcggatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 468 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLRMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 469 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacaggccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 470 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNRPYDGAIKQGVWNSFPVMEGWDHMDFINFIGSNTPGYFSIYGYYNDVANRVHSLPK

SEQ ID NO: 471 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacgcggacgttgctaatcgtgttcatagcctgccgaaa

SEQ ID NO: 472 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYADVANRVHSLPK

SEQ ID NO: 473 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagggcattgttagcttcatcaaggactttattatccacctggcttcggctgcgggtcaaaaacaggagagcttgatctatgatttcaagctggaccaatggggtttgaaacgtcagccgggtgagagcttcatggcgtacatgaaccgtgctatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 474 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEGIVSFIKDFIIHLASAAGQKQESLIYDFKLDQWGLKRQPGESFMAYMNRAMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 475 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtaggattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 476 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGRIKQGVWNSFPVMEGWDHMDFINFIGSNTPGYFSIYGYYNDVANRVHSLPK

SEQ ID NO: 477 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagggcattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtgatagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 478 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEGIVSFIKDFIIHLAAAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRDSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 479 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttgtgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 480 - protein, 386 aa, Artificial Sequence
  Variant of triacylglycerol lipase from Bacillus thermoamylovorans
METSGNDYPIVLVHGLGGWGKGEFVGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 481 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagggcattgttagcttcatcaaggactttattatccacctggctagcgctgcgggtcaaaaacaggagagcttgatctatgatttcaagctggaccaatggggtttgaaacgtcagccgggtgagagcttcatggcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttatgagcctgccgaaa

SEQ ID NO: 482 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEGIVSFIKDFIIHLASAAGQKQESLIYDFKLDQWGLKRQPGESFMAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVMSLPK

SEQ ID NO: 483 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctttgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 484 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASALGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 485 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggtgtgcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgcttgcgagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacacggcattgttagcttcatcaaggactttattatccacctggctagcgctgcgggtcaaaaacaggagagcttgatctatgatttcaagctggaccaatggggtttgaaacgtcagccgggtgagagcttcatggcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtgatagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttatgagcctgccgaaa

SEQ ID NO: 486 - protein, 386 aa, Artificial Sequence
  Variant of triacylglycerol lipase from Bacillus thermoamylovorans
METSGNDYPIVLVHGLGGWGKGEFLGVRYWGGLKDIEFYLNQTGHRTYVATVGPVSSNWDRAVELYYYIKGGTVDYGAAHACEHGHARFGRTYPGIYGQWDETNKIHLIGHSMGGQTSRMLVELLKSGSQKEQEYYSQHPEEGISPLFEGGKNWVHSVTSLATPHNGSTFADQHGIVSFIKDFIIHLASAAGQKQESLIYDFKLDQWGLKRQPGESFMAYMNRVMTSPIWESNDISAYDLTTLGAQELNQWMKTYPDVYYLSYTGNASYRGVVTGNYYPIGTMHPLFTLISLQMGRYTRDSPAPVIDRSWLPNDGIVNVVSAKYPFGHPNSPYDGAIKQGVWNSFPVMEGWDHMDFINFIGSNTPGYFSIYGFYNDVANRVMSLPK

SEQ ID NO: 487 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatcttaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 488 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDLTNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 489 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcagtgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 490 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESSDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 491 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatacgaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 492 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDTTNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 493 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattctgcacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 494 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFILHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 495 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcagggatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 496 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESRDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 497 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggtgtgcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgcttgcgagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacaccagattgtcagcttcatcaaggactttattatccacctggcttcggctgcgggtcaaaaacaggagagcttgatctatgatttcaagctggaccaatggggtttgaaacgtcagccgggtgagagcttcatggcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtgatagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 498 - protein, 386 aa, Artificial Sequence
  Variant of triacylglycerol lipase from Bacillus thermoamylovorans
METSGNDYPIVLVHGLGGWGKGEFLGVRYWGGLKDIEFYLNQTGHRTYVATVGPVSSNWDRAVELYYYIKGGTVDYGAAHACEHGHARFGRTYPGIYGQWDETNKIHLIGHSMGGQTSRMLVELLKSGSQKEQEYYSQHPEEGISPLFEGGKNWVHSVTSLATPHNGSTFADQHQIVSFIKDFIIHLASAAGQKQESLIYDFKLDQWGLKRQPGESFMAYMNRVMTSPIWESNDISAYDLTTLGAQELNQWMKTYPDVYYLSYTGNASYRGVVTGNYYPIGTMHPLFTLISLQMGRYTRDSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 499 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcggggatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 500 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESGDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 501 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 502 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 503 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctgcggctgcgggtcaaaaacaggagagcttgatctatgatttcaagctggaccaatggggtttgaaacgtcagccgggtgagagcttcatggcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 504 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLAAAAGQKQESLIYDFKLDQWGLKRQPGESFMAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 505 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcttaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 506 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGLKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 507 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtacgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 508 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGTIKQGVWNSFPVMEGWDHMDFINFIGSNTPGYFSIYGYYNDVANRVHSLPK

SEQ ID NO: 509 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtactaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 510 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGTKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 511 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttataattactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 512 - protein, 386 aa, Artificial Sequence
  Variant of triacylglycerol lipase from Bacillus thermoamylovorans
METSGNDYPIVLVHGLGGWGKGEFLGYNYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 513 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtagtattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 514 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGSIKQGVWNSFPVMEGWDHMDFINFIGSNTPGYFSIYGYYNDVANRVHSLPK

SEQ ID NO: 515 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacaggcaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 516 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYRQHPEEGISPLFEGGKNWVHSVTSLATPHNGSTFADQEQIVSFIKDFIIHLASAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 517 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttccatgcgtacatgaaccgtgttatgaccagcgagatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 518 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFHAYMNRVMTSEIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 519 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggtgtgcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtgatagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggttattacaacgacgttgctaatcgtgttcatagcctgccgaaa

SEQ ID NO: 520 - protein, 386 aa, Artificial Sequence
  Variant of triacylglycerol lipase from Bacillus thermoamylovorans
METWGNDYPIVLVHGLGGWGKGEFLGVRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLAAAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRDSPAPVIDRSWLPNDGIVNVVSAKYPFGHPNSPYDGAIKQGVWNSFPVMEGWDHMDFINFIGSNTPGYFSIYGYYNDVANRVHSLPK

SEQ ID NO: 521 - DNA, 1158 bp, Artificial Sequence
  Variant of triacylglycerol lipase from Bacillus thermoamylovorans
atggagacgtggggtaacgattatccgattgttctggttcacggtttgggtggttggggtaaaggcgaatttctgggttatcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctagcgctgcgggtcaaaaacaggagagcttgatctatgatttcaagctggaccaatggggtttgaaacgtcagccgggtgagagcttcatggcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtgatagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcaacatctacggtttttacaacgacgttgctaatcgtgttcatagcctgccgaaa

SEQ ID NO: 522 - protein, 386 aa, Artificial Sequence
  Variant of triacylglycerol lipase from Bacillus thermoamylovorans
METWGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLASAAGQKQESLIYDFKLDQWGLKRQPGESFMAYMNRVMTSPIWESNDISAYDLTTLGAQELNQWMKTYPDVYYLSYTGNASYRGVVTGNYYPIGTMHPLFTLISLQMGRYTRDSPAPVIDRSWLPNDGIVNVVSAKYPFGHPNSPYDGAIKQGVWNSFPVMEGWDHMDFINFIGSNTPGYFNIYGFYNDVANRVHSLPK

SEQ ID NO: 523 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctgcggctgcgggtcaaaaacaggagagcttgatctatgatttcaagctggaccaatggggtttgaaacgtcagccgggtgagagcttcatggcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtgatagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 524 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLAAAAGQKQESLIYDFKLDQWGLKRQPGESFMAYMNRVMTSPIWESNDISAYDLTTLGAQELNQWMKTYPDVYYLSYTGNASYRGVVTGNYYPIGTMHPLFTLISLQMGRYTRDSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 525 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggtgtgcgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagaacagattgttagcttcatcaaggactttattatccacctggctgcggctgcgggtcaaaaacaggagagcttgatctatgatttcaagctggaccaatggggtttgaaacgtcagccgggtgagagcttcatggcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 526 - protein, 386 aa, Artificial Sequence
  Variant of triacylglycerol lipase from Bacillus thermoamylovorans
METSGNDYPIVLVHGLGGWGKGEFLGVRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEQIVSFIKDFIIHLAAAAGQKQESLIYDFKLDQWGLKRQPGESFMAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 527 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacacctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcaaagcccacctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacgcagacgttgctaatcgtgttcatagcctgccgaaa

SEQ ID NO: 528 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQHLIVSFIKDFIIHLAAAAGLKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPPPVIDRSWLPNDGIVNVVSAKYPFGHPNSPYDGAIKQGVWNSFPVMEGWDHMDFINFIGSNTPGYFSIYGFYADVANRVHSLPK

SEQ ID NO: 529 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggttataaagacatcgagttttatttgaaccaaaccggtcatcgtacctacgttgctaccgttggtccggttagcagcaattgggatcgtgcggttgaattgtactattacattaagggtggtactgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacacctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttatgaccagcccgatttgggagagcaacgatatcagcgcttatgacctgaccacccgtggtgcgcaagagctgaaccagtggatgaagacctacccggacgtttattacttgagctataccggtaacgctagctaccgtggcgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 530 - protein, 386 aa, Artificial Sequence
  Variant of triacylglycerol lipase from Bacillus thermoamylovorans
METSGNDYPIVLVHGLGGWGKGEFLGYRYWGGYKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQHLIVSFIKDFIIHLAAAAGLKQESLIYDFKLDQWGLKRQPGESFHAYMNRVMTSPIWESNDISAYDLTTRGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 531 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggttataaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagggcattgttagcttcatcaaggactttattatccacctggctgcggctgcgggtcaaaaacaggagagcttgatctatgatttcaagctggaccaatggggtttgaaacgtcagccgggtgagagcttcatggcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggcgttgttaccggtaattattacccgattggtaccatgcacccgctgtttaccttgatcagcctgcaaatgggtcgctacacccgtcaaagcccacctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 532 - protein, 386 aa, Artificial Sequence
  Variant of triacylglycerol lipase from Bacillus thermoamylovorans
METSGNDYPIVLVHGLGGWGKGEFLGYRYWGGYKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEGIVSFIKDFIIHLAAAAGQKQESLIYDFKLDQWGLKRQPGESFMAYMNRVMTSPIWESNDISAYDLTTLGAQELNQWMKTYPDVYYLSYTGNASYRGVVTGNYYPIGTMHPLFTLISLQMGRYTRQSPPPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 533 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattcctaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 534 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRGVVTGNYYPIPTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 535 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacacctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttatgaccagcccgatttgggagagcaacgatatcagcgcttatgacctgaccaccttgggtgcgcaagagctgaaccagtggatgaagacctacccggacgtttattacttgagctataccggtaacgctagctaccgtggcgttgttaccggtaattattacccgattggtaccatgcacccgctgtttaccttgatcagcctgcaaatgggtcgctacacccgtcaaagcccagctccggttattgatcgtagctggctgccgaacgacggtatcgttaatgttgttagcgctaagtatccgttcggtcacccgaacagcccgtacgatggtgcgattaaacaaggtgtttggaatagctttccggttatggaaggttgggatcacatggacttcattaactttatcggtagcaataccccgggttatttcagcatctacggtttttacgcagacgttgctaatcgtgttcatagcctgccgaaa

SEQ ID NO: 536 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQHLIVSFIKDFIIHLAAAAGLKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYADVANRVHSLPK

SEQ ID NO: 537 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacttgagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 538 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKLESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 539 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 540 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPAPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 541 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaaattgagagcttgatctatgatttcaagctggaccaatggggtttgaaacgtcagccgggtgagagctttcatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 542 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKIESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 543 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacacggcattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggcgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 544 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQHGIVSFIKDFIIHLAAAAGLKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 545 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacacctgattgttagcttcatcaaggactttattatccacctggctgcggctgcgggtcaaaaacaggagagcttgatctatgatttcaagctggaccaatggggtttgaaacgtcagccgggtgagagcttcatggcgtacatgaaccgtgttatgaccagcccgatttgggagagccgcgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccacctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 546 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQHLIVSFIKDFIIHLAAAAGQKQESLIYDFKLDQWGLKRQPGESFMAYMNRVMTSPIWESRDISAYDLTTLGAQELNQWMKTYPDVYYLSYTGNASYRDVVTGNYYPIGTMHPLFTLISLRMGRYTRQSPPPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 547 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaatatgagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 548 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKYESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 549 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacacggcattgttagcttcatcaaggactttattatccacctggctgcggctgcgggtcaaaaacaggagagcttgatctatgatttcaagctggaccaatggggtttgaaacgtcagccgggtgagagcttcatggcgtacatgaaccgtgttatgaccagcccgatttgggagagcaacgatatcagcgcttatgacctgaccaccctgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcaaagcccagctccggttattgatcgtagctggctgccgaacgacggtatcgttaatgttgttagcgctaagtatccgttcggtcacccgaacagcccgtacgatggtgcgattaaaaaaggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 550 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQHGIVSFIKDFIIHLAAAAGQKQESLIYDFKLDQWGLKRQPGESFMAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKKGVWNSFPVMEGWDHMDFINFIGSNTPGYFSIYGFYNDVANRVHSLPK

SEQ ID NO: 551 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttgatggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 552 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRGVVDGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 553 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttttgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 554 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVLTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 555 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttcatggcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggcgttgttaccggtaattattacccgattggtaccatgcacccgctgtttaccttgatcagcctgcaaatgggtcgctacacccgtcaaagcccacctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 556 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFMAYMNRVMTSPIWESNDISAYDLTTLGAQELNQWMKTYPDVYYLSYTGNASYRGVVTGNYYPIGTMHPLFTLISLQMGRYTRQSPPPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 557 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgaggcgtatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 558 - protein, 386 aa, Artificial Sequence
  Variant of triacylglycerol lipase from Bacillus thermoamylovorans
METSGNDYPIVLVHGLGGWGKGEFLGYRYWGGLKDIEAYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 559 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgaggggtatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 560 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 561 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgtttagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 562 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPFSPYDGAIKQGVWNSFPVMEGWDHMDFINFIGSNTPGYFSIYGFYNDVANRVHSLPK

SEQ ID NO: 563 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgcatagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 564 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPHSPYDGAIKQGVWNSFPVMEGWDHMDFINFIGSNTPGYFSIYGFYNDVANRVHSLPK

SEQ ID NO: 565 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacggctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 566 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 567 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcaaatgggtcgctacacccgtcaaagcccacctccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 568 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGLKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLQMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 569 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgcattatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 570 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLHYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 571 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttgggacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 572 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAWDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 573 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttcatggcgtacatgaaccgtgttatgaccagcccgatttgggagagcaatgatatcagcgcttatgacctgaccacccgtggtgcgcaagagctgaaccagtggatgaagacctacccggacgtttattacttgagctataccggtaacgctagctaccgtggcgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 574 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFMAYMNRVMTSPIWESNDISAYDLTTRGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 575 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggttataaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 576 - protein, 386 aa, Artificial Sequence
  Variant of triacylglycerol lipase from Bacillus thermoamylovorans
METSGNDYPIVLVHGLGGWGKGEFLGYRYWGGYKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 577 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttcatggcgtacatgaaccgtgttatgaccagcccgatttgggagagcaatgatatcagcgcttatgacctgaccacccgtggtgcgcaagagctgaaccagtggatgaagacctacccggacgtttattacttgagctataccggtaacgctagctaccgtggcgttgttaccggtaattattacccgattggtaccatgcacccgctgtttaccttgatcagcctgcaaatgggtcgctacacccgtcaaagcccacctccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 578 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFMAYMNRVMTSPIWESNDISAYDLTTRGAQELNQWMKTYPDVYYLSYTGNASYRGVVTGNYYPIGTMHPLFTLISLQMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 579 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttcgatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 580 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFDAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 581 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagggcattgttagcttcatcaaggactttattatccacctggctgcggctgcgggtctgaaacaggagagcttgatctatgatttcaagctggaccaatggggtttgaaacgtcagccgggtgagagcttcatggcgtacatgaaccgtgttatgaccagcccgatttgggagagccgcgatatcagcgcttatgacctgaccacccgtggtgcgcaagagctgaaccagtggatgaagacctacccggacgtttattacttgagctataccggtaacgctagctaccgtggcgttgttaccggtaattattacccgattggtaccatgcacccgctgtttaccttgatcagcctgcaaatgggtcgctacacccgtcaaagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacgcagacgttgctaatcgtgttcatagcctgccgaaa

SEQ ID NO: 582 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEGIVSFIKDFIIHLAAAAGLKQESLIYDFKLDQWGLKRQPGESFMAYMNRVMTSPIWESRDISAYDLTTRGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYADVANRVHSLPK

SEQ ID NO: 583 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattaagaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 584 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRGVVTGNYYPIKTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 585 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatccaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 586 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIQDFIIHLAAAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 587 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtctgaaacaggagagcttgatctatgatttcaagctggaccaatggggtttgaaacgtcagccgggtgagagcttcatggcgtacatgaaccgtgttatgaccagcccgatttgggagagcaacgatatcagcgcttatgacctgaccacccgtggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcaaagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 588 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGLKQESLIYDFKLDQWGLKRQPGESFMAYMNRVMTSPIWESNDISAYDLTTRGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 589 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggttataaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacacctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaacgatatcagcgcttatgacctgaccaccttgggtgcgcaagagctgaaccagtggatgaagacctacccggacgtttattacttgagctataccggtaacgctagctaccgtggcgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 590 - protein, 386 aa, Artificial Sequence
  Variant of triacylglycerol lipase from Bacillus thermoamylovorans
METSGNDYPIVLVHGLGGWGKGEFLGYRYWGGYKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQHLIVSFIKDFIIHLAAAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 591 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttcccggcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 592 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFPAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 593 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttctgtgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 594 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFCAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 595 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctggcgtaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 596 - protein, 386 aa, Artificial Sequence
  Variant of triacylglycerol lipase from Bacillus thermoamylovorans
METSGNDYPIVLVHGLGGWGKGEFLAYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 597 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgcttgacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 598 - protein, 386 aa, Artificial Sequence
  Variant of triacylglycerol lipase from Bacillus thermoamylovorans
METSGNDYPIVLVHGLGGWGKGEFLGYRYWGGLLDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 599 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctcatgctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 600 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAHAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 601 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgtcgtaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 602 - protein, 386 aa, Artificial Sequence
  Variant of triacylglycerol lipase from Bacillus thermoamylovorans
METSGNDYPIVLVHGLGGWGKGEFLSYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 603 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgcggtaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 604 - protein, 386 aa, Artificial Sequence
  Variant of triacylglycerol lipase from Bacillus thermoamylovorans
METSGNDYPIVLVHGLGGWGKGEFLRYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 605 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggttataaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 606 - protein, 386 aa, Artificial Sequence
  Variant of triacylglycerol lipase from Bacillus thermoamylovorans
METSGNDYPIVLVHGLGGWGKGEFLGYRYWGGYKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGLKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 607 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggttataaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagggcattgttagcttcatcaaggactttattatccacctggctgcggctgcgggtcaaaaacaggagagcttgatctatgatttcaagctggaccaatggggtttgaaacgtcagccgggtgagagcttcatggcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggcgttgttaccggtaattattacccgattggtaccatgcacccgctgtttaccttgatcagcctgcaaatgggtcgctacacccgtcaaagcccagctccggttattgatcgtagctggctgccgaacgacggtatcgttaatgttgttagcgctaagtatccgttcggtcacccgaacagcccgtacactggtgcgattaaaaaaggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 608 - protein, 386 aa, Artificial Sequence
  Variant of triacylglycerol lipase from Bacillus thermoamylovorans
METSGNDYPIVLVHGLGGWGKGEFLGYRYWGGYKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEGIVSFIKDFIIHLAAAAGQKQESLIYDFKLDQWGLKRQPGESFMAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYTGAIKKGVWNSFPVMEGWDHMDFINFIGSNTPGYFSIYGFYNDVANRVHSLPK

SEQ ID NO: 609 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 610 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGLKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 611 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtttgagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 612 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGLSPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 613 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttggttcgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 614 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLVRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 615 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatccgacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 616 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHPTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 617 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagggcattgttagcttcatcaaggactttattatccacctggctgcggctgcgggtcaaaaacaggagagcttgatctatgatttcaagctggaccaatggggtttgaaacgtcagccgggtgagagcttcatggcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacgcagacgttgctaatcgtgttcatagcctgccgaaa

SEQ ID NO: 618 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEGIVSFIKDFIIHLAAAAGQKQESLIYDFKLDQWGLKRQPGESFMAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYADVANRVHSLPK

SEQ ID NO: 619 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtaccctggttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 620 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTLVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 621 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcagaaacaggagagcttgatctatgatttcaagctggaccaatggggtttgaaacgtcagccgggtgagagcttcatggcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 622 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFMAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 623 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacacctgattgttagcttcatcaaggactttattatccacctggctgcggctgcgggtcagaaacaggagagcttgatctatgatttcaagctggaccaatggggtttgaaacgtcagccgggtgagagcttcatggcgtacatgaaccgtgttatgaccagcccgatttgggagagcaacgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcaaatgggtcgctacacccgtcaaagcccacctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 624 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQHLIVSFIKDFIIHLAAAAGQKQESLIYDFKLDQWGLKRQPGESFMAYMNRVMTSPIWESNDISAYDLTTLGAQELNQWMKTYPDVYYLSYTGNASYRDVVTGNYYPIGTMHPLFTLISLQMGRYTRQSPPPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 625 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagggcattgttagcttcatcaaggactttattatccacctggctgcggctgcgggtctgaaacaggagagcttgatctatgatttcaagctggaccaatggggtttgaaacgtcagccgggtgagagcttcatggcgtacatgaaccgtgttatgaccagcccgatttgggagagcaacgatatcagcgcttatgacctgaccacccgtggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcaaagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 626 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQEGIVSFIKDFIIHLAAAAGLKQESLIYDFKLDQWGLKRQPGESFMAYMNRVMTSPIWESNDISAYDLTTRGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 627 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggcgttgttaccggtaattattacccgattggtaccatgcacccgctgtttaccttgatcagcctgcgcatgggtcgctacacccgtcaaagcccacctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 628 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGLKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLRMGRYTRQSPPPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 629 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaactcaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 630 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQTQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 631 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacacctgattgttagcttcatcaaggactttattatccacctggctgcggctgcgggtcagaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtggtgttgttaccggtaattattacccgattggtaccatgcacccgctgtttaccttgatcagcctgcaaatgggtcgctacacccgtcagagcccagctccggttattgatcgtagctggctgccgaacgacggtatcgttaatgttgttagcgctaagtatccgttcggtcacccgaacagcccgtacgatggtgcgattaaacaaggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 632 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQHLIVSFIKDFIIHLAAAAGQKQESLIYDFKLDQWGLKRQPGESFHAYMNRVMTSPIWESNDISAYDLTTLGAQELNQWMKTYPDVYYLSYTGNASYRGVVTGNYYPIGTMHPLFTLISLQMGRYTRQSPAPVIDRSWLPNDGIVNVVSAKYPFGHPNSPYDGAIKQGVWNSFPVMEGWDHMDFINFIGSNTPGYFSIYGFYNDVANRVHSLPK

SEQ ID NO: 633 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacaccgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtgggtgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatcactttccggttatggaaggttgggatcacatggacttcattaactttatcggtagcaataccccgggttatttcagcatctacggtttttacaacgacgttgctaatcgtgttcatagcctgccgaaa

SEQ ID NO: 634 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWVKTYPDVYYLSYTGNASYRDVVTGNYYPIGTMHPLFTLISLRMGRYTRQSPAPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 635 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagggctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccctgggtgcgcaagagctgaaccagtggatgaagacctacccggacgtttattacttgagctataccggtaacgctagctaccgtgacgttgttactggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaatagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 636 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQGLIVSFIKDFIIHLAAAAGLKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 637 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacatctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggatgaagacctacccggacgtttattacttgagctataccggtaacgctagctaccgtgacgttgttactggtaattattacccgattaagaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgcatagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 638 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQHLIVSFIKDFIIHLAAAAGQKQESLIYDFKLDQWGLKRQPGESFHAYMNRVLTSPIWESNDISAYDLTTRGAQELNQWMKTYPDVYYLSYTGNASYRDVVTGNYYPIKTMHPLFTLISLRMGRYTRQSPAPVIDRSWLPNDGIVNVVSAKYPFGHPHSPYTGAIKQGVWNSFPVMEGWDHMDFINFIGSNTPGYFSIYGFYNDVANRVHSLPK

SEQ ID NO: 639 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttctatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagggctgattgttagcttcatcaaggactttattatccacctggctgcggctgcgggtcagaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggatgaagacctacccggacgtttattacttgagctataccggtaacgctagctaccgtgacgttgttactggtaattattacccgattcctaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagcattccggttatggaaggttgggatcacatggacttcattaactttatcggtagcaataccccgggttatttcagcatctacggtttttacaacgacgttgctaatcgtgttcatagcctgccgaaa

SEQ ID NO: 640 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQGLIVSFIKDFIIHLAAAAGQKQESLIYDFKLDQWGLKRQPGESFHAYMNRVLTSPIWESNDISAYDLTTRGAQELNQWMKTYPDVYYLSYTGNASYRDVVTGNYYPIPTMHPLFTLISLRMGRYTRQSPPPVIDRSWLPNDGIVNVVSAKYPFGHPNSPYTGAIKQGVWNSIPVMEGWDHMDFINFIGSNTPGYFSIYGFYNDVANRVHSLPK

SEQ ID NO: 641 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttctatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacgtctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccctgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 642 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 643 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacatctgattgttagcttcatcaaggactttattatccacctggctgcggctgcgggtcagaaactggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccctgggtgcgcaagagctgaaccagtggatgaagacctacccggacgtttattacttgagctataccggtaacgctagctaccgtgacgttgttactggtaattattacccgattcctaccatgcacccgctgtttaccttgatcagcctgcgcatgggtcgctacacccgtcaaagcccagcaccggttattgatcgtagctggctgccgaacgacggtatcgttaatgttgttagcgctaagtatccgttcggtcacccgtttagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 644 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQHLIVSFIKDFIIHLAAAAGQKLESLIYDFKLDQWGLKRQPGESFHAYMNRVMTSPIWESNDISAYDLTTLGAQELNQWMKTYPDVYYLSYTGNASYRDVVTGNYYPIPTMHPLFTLISLRMGRYTRQSPAPVIDRSWLPNDGIVNVVSAKYPFGHPFSPYTGAIKQGVWNSFPVMEGWDHMDFINFIGSNTPGYFSIYGFYNDVANRVHSLPK

SEQ ID NO: 645 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacgtctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 646 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGQKQESLIYDFKLDQWGLKRQPGESFHAYMNRVLTSPIWESNDISAYDLTTLGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 647 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagggctgattgttagcttcatcaaggactttattatccacctggctgcggctgcgggtcagaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttactggtaattattacccgattaagaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaatagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 648 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQGLIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIKTMHPLFTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 649 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttctatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgcatagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 650 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGLKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPPPVIDRSWLPNDGIVNVVSAKYPFGHPHSPYTGAIKQGVWNSFPVMEGWDHMDFINFIGSNTPGYFSIYGFYNDVANRVHSLPK

SEQ ID NO: 651 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgaggcttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcagaaatacgagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccctgggtgcgcaagagctgaaccagtggatgaagacctacccggacgtttattacttgagctataccggtaacgctagctaccgtgacgttgttactggtaattattacccgattaagaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgtttagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 652 - protein, 386 aa, Artificial Sequence
  Variant of triacylglycerol lipase from Bacillus thermoamylovorans
METSGNDYPIVLVHGLGGWGKGEFLGYRYWGGLKDIEAYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKYESLIYDFKLDQWGLKRQPGESFHAYMNRVMTSPIWESNDISAYDLTTLGAQELNQWMKTYPDVYYLSYTGNASYRDVVTGNYYPIKTMHPLFTLISLRMGRYTRQSPPPVIDRSWLPNDGIVNVVSAKYPFGHPFSPYTGAIKQGVWNSFPVMEGWDHMDFINFIGSNTPGYFSIYGFYNDVANRVHSLPK

SEQ ID NO: 653 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacaccgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttcaactgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtgggtgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgcgaagtatccgttcggtcacccgaacagcccgtacactggtgcgattaaacagggtgtttggaatcactttccggttatggaaggttgggatcacatggacttcattaactttatcggtagcaataccccgggttatttcagcatctacggtttttacaacgacgttgctaatcgtgttcatagcctgccgaaa

SEQ ID NO: 654 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYTATVGPVSSNWDRAVELYYYIHGGTVDYGAAHAKEHGHARFGRTYPGIYGQWDETNKIHLIGHSMGGQTSRMLVQLLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWVKTYPDVYYLSYTGNASYRDVVTGNYYPIGTMHPLFTLISLRMGRYTRQSPAPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 655 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgagttctatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttactggtaattattacccgattcctaccatgcacccgctgtttaccttgatcagcctgcgcatgggtcgctacacccgtcaaagcccagcaccggttattgatcgtagctggctgccgaacgacggtatcgttaatgttgttagcgctaagtatccgttcggtcacccgcatagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 656 - protein, 386 aa, Artificial Sequence
  Variant of triacylglycerol lipase from Bacillus thermoamylovorans
METSGNDYPIVLVHGLGGWGKGEFLGYRYWGGLLDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIPTMHPLFTLISLRMGRYTRQSPAPVIDRSWLPNDGIVNVVSAKYPFGHPHSPYTGAIKQGVWNSFPVMEGWDHMDFINFIGSNTPGYFSIYGFYNDVANRVHSLPK

SEQ ID NO: 657 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttctatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacgtctgattgttagcttcatcaaggactttattatccacctggctgcggctgcgggtcagaaaattgagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttactggtaattattacccgattaagaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 658 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGQKIESLIYDFKLDQWGLKRQPGESFHAYMNRVMTSPIWESNDISAYDLTTLGAQELNQWMKTYPDVYYLSYTGNASYRDVVTGNYYPIKTMHPLFTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 659 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgaggcttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacgtctgattgttagcttcatcaaggactttattatccacctggctgcggctgcgggtcagaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccctgggtgcgcaagagctgaaccagtggatgaagacctacccggacgtttattacttgagctataccggtaacgctagctaccgtgacgttgttactggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaatagcccgtacactggtgcgattaaacagggtgtttggaatagcattccggttatggaaggttgggatcacatggacttcattaactttatcggtagcaataccccgggttatttcagcatctacggtttttacaacgacgttgctaatcgtgttcatagcctgccgaaa

SEQ ID NO: 660 - protein, 386 aa, Artificial Sequence
  Variant of triacylglycerol lipase from Bacillus thermoamylovorans
METSGNDYPIVLVHGLGGWGKGEFLGYRYWGGLLDIEAYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNSIPVMEGWDHMDFINFIGSNTPGYFSIYGFYNDVANRVHSLPK

SEQ ID NO: 661 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacatctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccctgggtgcgcaagagctgaaccagtggatgaagacctacccggacgtttattacttgagctataccggtaacgctagctaccgtgacgttgttactggtaattattacccgattaagaccatgcacccgctgtttaccttgatcagcctgcgcatgggtcgctacacccgtcaaagcccagcaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 662 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQHLIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIKTMHPLFTLISLRMGRYTRQSPAPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 663 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgaggcttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagggctgattgttagcttcatcaaggactttattatccacctggctgcggctgcgggtctgaaactggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccacccgtggtgcgcaagagctgaaccagtggatgaagacctacccggacgtttattacttgagctataccggtaacgctagctaccgtgacgttgttactggtaattattacccgattcctaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgtttagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 664 - protein, 386 aa, Artificial Sequence
  Variant of triacylglycerol lipase from Bacillus thermoamylovorans
METSGNDYPIVLVHGLGGWGKGEFLGYRYWGGLLDIEAYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQGLIVSFIKDFIIHLAAAAGLKLESLIYDFKLDQWGLKRQPGESFHAYMNRVMTSPIWESNDISAYDLTTRGAQELNQWMKTYPDVYYLSYTGNASYRDVVTGNYYPIPTMHPLFTLISLRMGRYTRQSPPPVIDRSWLPNDGIVNVVSAKYPFGHPFSPYTGAIKQGVWNSFPVMEGWDHMDFINFIGSNTPGYFSIYGFYNDVANRVHSLPK

SEQ ID NO: 665 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcagaaatacgagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccacccgtggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 666 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKYESLIYDFKLDQWGLKRQPGESFHAYMNRVMTSPIWESNDISAYDLTTRGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 667 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacaccgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgaactgttgaagagcggtagccaaaaagaacaggagtattacagccaacatccggaagagggtattagcccgctgttcgaaggtggtaaaaactgggttcacagcgttaccagcttggctaccccacataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatcactttccggttatggaaggttgggatcacatggacttcattaactttatcggtagcaataccccgggttatttcagcatctacggtttttacaacgacgttgctaatcgtgttcatagcctgccgaaa

SEQ ID NO: 668 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPAPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 669 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgagttctatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagggctgattgttagcttcatcaaggactttattatccacctggctgcggctgcgggtctgaaactggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccacccgtggtgcgcaagagctgaaccagtggatgaagacctacccggacgtttattacttgagctataccggtaacgctagctaccgtgacgttgttactggtaattattacccgattcctaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 670 - protein, 386 aa, Artificial Sequence
  Variant of triacylglycerol lipase from Bacillus thermoamylovorans
METSGNDYPIVLVHGLGGWGKGEFLGYRYWGGLLDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQGLIVSFIKDFIIHLAAAAGLKLESLIYDFKLDQWGLKRQPGESFHAYMNRVMTSPIWESNDISAYDLTTRGAQELNQWMKTYPDVYYLSYTGNASYRDVVTGNYYPIPTMHPLFTLISLRMGRYTRQSPAPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 671 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgagttctatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccacccgtggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgtttagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 672 - protein, 386 aa, Artificial Sequence
  Variant of triacylglycerol lipase from Bacillus thermoamylovorans
METSGNDYPIVLVHGLGGWGKGEFLGYRYWGGLLDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGLKQESLIYDFKLDQWGLKRQPGESFHAYMNRVMTSPIWESNDISAYDLTTRGAQELNQWMKTYPDVYYLSYTGNASYRDVVTGNYYPIGTMHPLFTLISLRMGRYTRQSPPPVIDRSWLPNDGIVNVVSAKYPFGHPFSPYTGAIKQGVWNSFPVMEGWDHMDFINFIGSNTPGYFSIYGFYNDVANRVHSLPK

SEQ ID NO: 673 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttctatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagggctgattgttagcttcatcaaggactttattatccacctggctgcggctgcgggtcagaaaattgagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtggatgaagacctacccggacgtttattacttgagctataccggtaacgctagctaccgtgacgttgttactggtaattattacccgattaagaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgtttagcccgtacactggtgcgattaaacagggtgtttggaatagcattccggttatggaaggttgggatcacatggacttcattaactttatcggtagcaataccccgggttatttcagcatctacggtttttacaacgacgttgctaatcgtgttcatagcctgccgaaa

SEQ ID NO: 674 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQGLIVSFIKDFIIHLAAAAGQKIESLIYDFKLDQWGLKRQPGESFHAYMNRVLTSPIWESNDISAYDLTTLGAQELNQWMKTYPDVYYLSYTGNASYRDVVTGNYYPIKTMHPLFTLISLRMGRYTRQSPPPVIDRSWLPNDGIVNVVSAKYPFGHPFSPYTGAIKQGVWNSIPVMEGWDHMDFINFIGSNTPGYFSIYGFYNDVANRVHSLPK

SEQ ID NO: 675 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgaggcttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcagaaaattgagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 676 - protein, 386 aa, Artificial Sequence
  Variant of triacylglycerol lipase from Bacillus thermoamylovorans
METSGNDYPIVLVHGLGGWGKGEFLGYRYWGGLKDIEAYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKIESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 677 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgagttctatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtctgaaaattgagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 678 - protein, 386 aa, Artificial Sequence
  Variant of triacylglycerol lipase from Bacillus thermoamylovorans
METSGNDYPIVLVHGLGGWGKGEFLGYRYWGGLLDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGLKIESLIYDFKLDQWGLKRQPGESFHAYMNRVLTSPIWESNDISAYDLTTRGAQELNQWMKTYPDVYYLSYTGNASYRDVVTGNYYPIGTMHPLFTLISLRMGRYTRQSPAPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 679 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaattggtttccggttatggaaggttgggatcacatggacttcattaactttatcggtagcaataccccgggttatttcagcatctacggtttttacaacgacgttgctaatcgtgttcatagcctgccgaaa

SEQ ID NO: 680 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPAPVIDRSWLPNDGIVNVVSAKYPFGHPNSPYTGAIKQGVWNWFPVMEGWDHMDFINFIGSNTPGYFSIYGFYNDVANRVHSLPK

SEQ ID NO: 681 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacaccgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgaactgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggtggccgaacgacggtatcgttaatgttgttagcgctaagtatccgttcggtcacccgaacagcccgtacactggtgcgattaaacagggtgtttggaatcactttccggttatggaaggttgggatcacatggacttcattaactttatcggtagcaataccccgggttatttcagcatctacggtttttacaacgacgttgctaatcgtgttcatagcctgccgaaa

SEQ ID NO: 682 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPAPVIDRSWWPNDGIVNVVSAKYPFGHPNSPYTGAIKQGVWNHFPVMEGWDHMDFINFIGSNTPGYFSIYGFYNDVANRVHSLPK

SEQ ID NO: 683 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttcaactgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtgggtgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgcgaagtatccgttcggtcacccgaacagcccgtacactggtgcgattaaacagggtgtttggaatcactttccggttatggaaggttgggatcacatggacttcattaactttatcggtagcaataccccgggttatttcagcatctacggtttttacaacgacgttgctaatcgtgttcatagcctgccgaaa

SEQ ID NO: 684 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIHGGTVDYGAAHAKEHGHARFGRTYPGIYGQWDETNKIHLIGHSMGGQTSRMLVQLLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWVKTYPDVYYLSYTGNASYRDVVTGNYYPIGTMHPLFTLISLRMGRYTRQSPAPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 685 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcagaaatacgagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttactggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgcatagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 686 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKYESLIYDFKLDQWGLKRQPGESFHAYMNRVLTSPIWESNDISAYDLTTLGAQELNQWMKTYPDVYYLSYTGNASYRDVVTGNYYPIGTMHPLFTLISLRMGRYTRQSPPPVIDRSWLPNDGIVNVVSAKYPFGHPHSPYTGAIKQGVWNSFPVMEGWDHMDFINFIGSNTPGYFSIYGFYNDVANRVHSLPK

SEQ ID NO: 687 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgagttctatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacatctgattgttagcttcatcaaggactttattatccacctggctgcggctgcgggtctgaaaattgagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgtttagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 688 - protein, 386 aa, Artificial Sequence
  Variant of triacylglycerol lipase from Bacillus thermoamylovorans
METSGNDYPIVLVHGLGGWGKGEFLGYRYWGGLLDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQHLIVSFIKDFIIHLAAAAGLKIESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPPPVIDRSWLPNDGIVNVVSAKYPFGHPFSPYTGAIKQGVWNSFPVMEGWDHMDFINFIGSNTPGYFSIYGFYNDVANRVHSLPK

SEQ ID NO: 689 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacaccgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttaccctcaatgggatgaaaccaataagattcacctgatcggtcatagcatgggtggtcagaccagccgtacgttggttgaactgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtgggtgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatcactttccggttatggaaggttgggatcacatggacttcattaactttatcggtagcaataccccgggttatttcagcatctacggtttttacaacgacgttgctaatcgtgttcatagcctgccgaaa

SEQ ID NO: 690 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYTATVGPVSSNWDRAVELYYYIHGGTVDYGAAHAKEHGHARFGRTYPGIYPQWDETNKIHLIGHSMGGQTSRTLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWVKTYPDVYYLSYTGNASYRDVVTGNYYPIGTMHPLFTLISLRMGRYTRQSPAPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 691 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctgccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtgggtgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatcactttccggttatggaaggttgggatcacatggacttcattaactttatcggtagcaataccccgggttatttcagcatctacggtttttacaacgacgttgctaatcgtgttcatagcctgccgaaa

SEQ ID NO: 692 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVAAVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWVKTYPDVYYLSYTGNASYRDVVTGNYYPIGTMHPLFTLISLRMGRYTRQSPAPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 693 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgagttctatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagggctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagcaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 694 - protein, 386 aa, Artificial Sequence
  Variant of triacylglycerol lipase from Bacillus thermoamylovorans
METSGNDYPIVLVHGLGGWGKGEFLGYRYWGGLLDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQGLIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPAPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 695 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttctatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacatctgattgttagcttcatcaaggactttattatccacctggctgcggctgcgggtcagaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttactggtaattattacccgattcctaccatgcacccgctgtttaccttgatcagcctgcgcatgggtcgctacacccgtcaaagcccagcaccggttattgatcgtagctggctgccgaacgacggtatcgttaatgttgttagcgctaagtatccgttcggtcacccgcatagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 696 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQHLIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIPTMHPLFTLISLRMGRYTRQSPAPVIDRSWLPNDGIVNVVSAKYPFGHPHSPYTGAIKQGVWNSFPVMEGWDHMDFINFIGSNTPGYFSIYGFYNDVANRVHSLPK

SEQ ID NO: 697 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgaggcttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacgtctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccctgggtgcgcaagagctgaaccagtggatgaagacctacccggacgtttattacttgagctataccggtaacgctagctaccgtgacgttgttactggtaattattacccgattaagaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagcattccggttatggaaggttgggatcacatggacttcattaactttatcggtagcaataccccgggttatttcagcatctacggtttttacaacgacgttgctaatcgtgttcatagcctgccgaaa

SEQ ID NO: 698 - protein, 386 aa, Artificial Sequence
  Variant of triacylglycerol lipase from Bacillus thermoamylovorans
METSGNDYPIVLVHGLGGWGKGEFLGYRYWGGLKDIEAYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIKTMHPLFTLISLRMGRYTRQSPPPVIDRSWLPNDGIVNVVSAKYPFGHPNSPYTGAIKQGVWNSIPVMEGWDHMDFINFIGSNTPGYFSIYGFYNDVANRVHSLPK

SEQ ID NO: 699 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctgccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatcactttccggttatggaaggttgggatcacatggacttcattaactttatcggtagcaataccccgggttatttcagcatctacggtttttacaacgacgttgctaatcgtgttcatagcctgccgaaa

SEQ ID NO: 700 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVAAVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPAPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 701 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacgtctgattgttagcttcatcaaggactttattatccacctggctgcggctgcgggtctgaaactggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccacccgtggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagcaccggttattgatcgtagctggctgccgaacgacggtatcgttaatgttgttagcgctaagtatccgttcggtcacccgcatagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 702 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGLKLESLIYDFKLDQWGLKRQPGESFHAYMNRVMTSPIWESNDISAYDLTTRGAQELNQWMKTYPDVYYLSYTGNASYRDVVTGNYYPIGTMHPLFTLISLRMGRYTRQSPAPVIDRSWLPNDGIVNVVSAKYPFGHPHSPYTGAIKQGVWNSFPVMEGWDHMDFINFIGSNTPGYFSIYGFYNDVANRVHSLPK

SEQ ID NO: 703 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctcttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 704 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPAPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 705 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatatttttccggttatggaaggttgggatcacatggacttcattaactttatcggtagcaataccccgggttatttcagcatctacggtttttacaacgacgttgctaatcgtgttcatagcctgccgaaa

SEQ ID NO: 706 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPAPVIDRSWLPNDGIVNVVSAKYPFGHPNSPYTGAIKQGVWNIFPVMEGWDHMDFINFIGSNTPGYFSIYGFYNDVANRVHSLPK

SEQ ID NO: 707 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttctatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacgtctgattgttagcttcatcaaggactttattatccacctggctgcggctgcgggtctgaaaattgagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagcaccggttattgatcgtagctggctgccgaacgacggtatcgttaatgttgttagcgctaagtatccgttcggtcacccgaatagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 708 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGLKIESLIYDFKLDQWGLKRQPGESFHAYMNRVLTSPIWESNDISAYDLTTLGAQELNQWMKTYPDVYYLSYTGNASYRDVVTGNYYPIGTMHPLFTLISLRMGRYTRQSPAPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 709 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcagaaaattgagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttactggtaattattacccgattcctaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgtttagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 710 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKIESLIYDFKLDQWGLKRQPGESFHAYMNRVMTSPIWESNDISAYDLTTLGAQELNQWMKTYPDVYYLSYTGNASYRDVVTGNYYPIPTMHPLFTLISLRMGRYTRQSPAPVIDRSWLPNDGIVNVVSAKYPFGHPFSPYTGAIKQGVWNSFPVMEGWDHMDFINFIGSNTPGYFSIYGFYNDVANRVHSLPK

SEQ ID NO: 711 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatgtgtttccggttatggaaggttgggatcacatggacttcattaactttatcggtagcaataccccgggttatttcagcatctacggtttttacaacgacgttgctaatcgtgttcatagcctgccgaaa

SEQ ID NO: 712 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPAPVIDRSWLPNDGIVNVVSAKYPFGHPNSPYTGAIKQGVWNVFPVMEGWDHMDFINFIGSNTPGYFSIYGFYNDVANRVHSLPK

SEQ ID NO: 713 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgaggcttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtctgaaactggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttactggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaatagcccgtacactggtgcgattaaacagggtgtttggaatagcattccggttatggaaggttgggatcacatggacttcattaactttatcggtagcaataccccgggttatttcagcatctacggtttttacaacgacgttgctaatcgtgttcatagcctgccgaaa

SEQ ID NO: 714 - protein, 386 aa, Artificial Sequence
  Variant of triacylglycerol lipase from Bacillus thermoamylovorans
METSGNDYPIVLVHGLGGWGKGEFLGYRYWGGLKDIEAYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGLKLESLIYDFKLDQWGLKRQPGESFHAYMNRVLTSPIWESNDISAYDLTTLGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNSIPVMEGWDHMDFINFIGSNTPGYFSIYGFYNDVANRVHSLPK

SEQ ID NO: 715 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacaccgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtacgttggttgaactgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtgggtgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatcactttccggttatggaaggttgggatcacatggacttcattaactttatcggtagcaataccccgggttatttcagcatctacggtttttacaacgacgttgctaatcgtgttcatagcctgccgaaa

SEQ ID NO: 716 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYTATVGPVSSNWDRAVELYYYIHGGTVDYGAAHAKEHGHARFGRTYPGIYGQWDETNKIHLIGHSMGGQTSRTLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWVKTYPDVYYLSYTGNASYRDVVTGNYYPIGTMHPLFTLISLRMGRYTRQSPAPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 717 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgaggcttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacatctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtggatgaagacctacccggacgtttattacttgagctataccggtaacgctagctaccgtgacgttgttgatggtaattattacccgattggtaccatacacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgtttagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 718 - protein, 386 aa, Artificial Sequence
  Variant of triacylglycerol lipase from Bacillus thermoamylovorans
METSGNDYPIVLVHGLGGWGKGEFLGYRYWGGLKDIEAYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQHLIVSFIKDFIIHLAAAAGLKQESLIYDFKLDQWGLKRQPGESFHAYMNRVLTSPIWESNDISAYDLTTLGAQELNQWMKTYPDVYYLSYTGNASYRDVVDGNYYPIGTIHPLFTLISLRMGRYTRQSPPPVIDRSWLPNDGIVNVVSAKYPFGHPFSPYTGAIKQGVWNSFPVMEGWDHMDFINFIGSNTPGYFSIYGFYNDVANRVHSLPK

SEQ ID NO: 719 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacaccgctgccgttggtccggttagcagcaattgggatcgtgcggttgaattgtactattacattcatggtggtaccgttgactacggtgctgcgcacgctaaagagcacggtcatgcgcgtttcggtcgtacctatccgggtatttaccctcaatgggatgaaaccaataagattcacctgatcggtcatagcatgggtggtcagaccagccgtatgttggttgaactgttgaagagcggcagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtgggtgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggtggccgaacgacggtatcgttaatgttgttagcgcgaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 720 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYTAAVGPVSSNWDRAVELYYYIHGGTVDYGAAHAKEHGHARFGRTYPGIYPQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWVKTYPDVYYLSYTGNASYRDVVTGNYYPIGTMHPLFTLISLRMGRYTRQSPAPVIDRSWWPNDGIVNVVSAKYPFGHPNSPYTGAIKQGVWNSFPVMEGWDHMDFINFIGSNTPGYFSIYGFYNDVANRVHSLPK

SEQ ID NO: 721 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 722 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPAPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 723 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttaccctcaatgggatgaaaccaataagattcacctgatcggtcatagcatgggtggtcagaccagccgtatgttggttgaactgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatcactttccggttatggaaggttgggatcacatggacttcattaactttatcggtagcaataccccgggttatttcagcatctacggtttttacaacgacgttgctaatcgtgttcatagcctgccgaaa

SEQ ID NO: 724 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIHGGTVDYGAAHAKEHGHARFGRTYPGIYPQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPAPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 725 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacaccgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttcaactgttgaagagcggcagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctatagcggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatcactttccggttatggaaggttgggatcacatggacttcattaactttatcggtagcaataccccgggttatttcagcatctacggtttttacaacgacgttgctaatcgtgttcatagcctgccgaaa

SEQ ID NO: 726 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYTATVGPVSSNWDRAVELYYYIHGGTVDYGAAHAKEHGHARFGRTYPGIYGQWDETNKIHLIGHSMGGQTSRMLVQLLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYSGNASYRDVVTGNYYPIGTMHPLFTLISLRMGRYTRQSPAPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 727 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttctatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacatctgattgttagcttcatcaaggactttattatccacctggctgcggctgcgggtcagaaaattgagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccacccgtggtgcgcaagagctgaaccagtggatgaagacctacccggacgtttattacttgagctataccggtaacgctagctaccgtgacgttgttactggtaattattacccgattaagaccatgcacccgctgtttaccttgatcagcctgcgcatgggtcgctacacccgtcaaagcccagcaccggttattgatcgtagctggctgccgaacgacggtatcgttaatgttgttagcgctaagtatccgttcggtcacccgaatagcccgtacactggtgcgattaaacagggtgtttggaatagcattccggttatggaaggttgggatcacatggacttcattaactttatcggtagcaataccccgggttatttcagcatctacggtttttacaacgacgttgctaatcgtgttcatagcctgccgaaa

SEQ ID NO: 728 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQHLIVSFIKDFIIHLAAAAGQKIESLIYDFKLDQWGLKRQPGESFHAYMNRVMTSPIWESNDISAYDLTTRGAQELNQWMKTYPDVYYLSYTGNASYRDVVTGNYYPIKTMHPLFTLISLRMGRYTRQSPAPVIDRSWLPNDGIVNVVSAKYPFGHPNSPYTGAIKQGVWNSIPVMEGWDHMDFINFIGSNTPGYFSIYGFYNDVANRVHSLPK

SEQ ID NO: 729 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctacttaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 730 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNATYRDVVTGNYYPIGTMHPLFTLISLRMGRYTRQSPAPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 731 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcagaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 732 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPAPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 733 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctactcggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 734 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYSATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPAPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 735 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccactttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 736 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTTLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPAPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 737 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacaccgctgccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttcaactgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtgggtgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatcactttccggttatggaaggttgggatcacatggacttcattaactttatcggtagcaataccccgggttatttcagcatctacggtttttacaacgacgttgctaatcgtgttcatagcctgccgaaa

SEQ ID NO: 738 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYTAAVGPVSSNWDRAVELYYYIHGGTVDYGAAHAKEHGHARFGRTYPGIYGQWDETNKIHLIGHSMGGQTSRMLVQLLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWVKTYPDVYYLSYTGNASYRDVVTGNYYPIGTMHPLFTLISLRMGRYTRQSPAPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 739 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctgttgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 740 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVAVVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPAPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 741 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtgggtgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 742 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWVKTYPDVYYLSYTGNASYRDVVTGNYYPIGTMHPLFTLISLRMGRYTRQSPAPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 743 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacaccgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttcaactgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggtggccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 744 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYTATVGPVSSNWDRAVELYYYIHGGTVDYGAAHAKEHGHARFGRTYPGIYGQWDETNKIHLIGHSMGGQTSRMLVQLLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPAPVIDRSWWPNDGIVNVVSAKYPFGHPNSPYTGAIKQGVWNSFPVMEGWDHMDFINFIGSNTPGYFSIYGFYNDVANRVHSLPK

SEQ ID NO: 745 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttaccggcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 746 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIHGGTVDYGAAHAKEHGHARFGRTYPGIYRQWDETNKIHLIGHSMGGQTSRMLVELLKSGSQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPAPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 747 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaagacatcgagttttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggttttcaaaaagaacaggagtattacagccaacatccggaagagggtattagcccgctgttcgaaggtggtaaaaactgggttcacagcgttaccagcttggctaccccgcataatggtagcacctttgcggatcaagagctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccaccttgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccagctccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 748 - protein, 386 aa, Artificial Sequence
  Variant of triacylglycerol lipase from Bacillus thermoamylovorans
METSGNDYPIVLVHGLGGWGKGEFLGYRYWGGLKDIEFYLNQTGHRTYVATVGPVSSNWDRAVELYYYIHGGTVDYGAAHAKEHGHARFGRTYPGIYGQWDETNKIHLIGHSMGGQTSRMLVELLKSGFQKEQEYYSQHPEEGISPLFEGGKNWVHSVTSLATPHNGSTFADQELIVSFIKDFIIHLAAAAGQKQESLIYDFKLDQWGLKRQPGESFHAYMNRVMTSPIWESNDISAYDLTTLGAQELNQWMKTYPDVYYLSYTGNASYRDVVTGNYYPIGTMHPLFTLISLRMGRYTRQSPAPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 749 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcctggctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtgggtgaagacctacccggacgtttattacttgagctataccggtaacgctagctaccgtgacgttgttaccggtaattattacccgattccgaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 750 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGLKQESLIYDFKLDQWGLKRQPGESFHAYMNRVLTSPIWESNDISAYDLTTLGAQELNQWVKTYPDVYYLSYTGNASYRDVVTGNYYPIPTMHPLFTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 751 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacgtggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaggaacaggagtattacagccaacatccggaagagggtattagcccgctgttcgaaggtggtaaaaactgggttcacagcgttaccagcctggctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtggatgaagacctacccggacgtttattacttgagctataccggtaacgctacttaccgtgacgttgttaccggtaattattacccgattccgaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaattcgtttccggttatggaaggttgggatcacatggacttcattaactttatcggtagcaataccccgggttatttcagcatctacggtttttacaacgacgttgctaatcgtgttcatagcctgccgaaa

SEQ ID NO: 752 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGLKQESLIYDFKLDQWGLKRQPGESFHAYMNRVLTSPIWESNDISAYDLTTLGAQELNQWMKTYPDVYYLSYTGNATYRDVVTGNYYPIPTMHPLFTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 753 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcctggctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggatgaagacctacccggacgtttattacttgagctataccggtaacgctagttaccgtgacgttgttaccggtaattattacccgattccgaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaattggtttccggttatggaaggttgggatcacatggacttcattaactttatcggtagcaataccccgggttatttcagcatctacggtttttacaacgacgttgctaatcgtgttcatagcctgccgaaa

SEQ ID NO: 754 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGLKQESLIYDFKLDQWGLKRQPGESFHAYMNRVLTSPIWESNDISAYDLTTRGAQELNQWMKTYPDVYYLSYTGNASYRDVVTGNYYPIPTMHPLFTLISLRMGRYTRQSPPPVIDRSWLPNDGIVNVVSAKYPFGHPNSPYTGAIKQGVWNWFPVMEGWDHMDFINFIGSNTPGYFSIYGFYNDVANRVHSLPK

SEQ ID NO: 755 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcctggctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtggatgaagacctacccggacgtttattacttgagctataccggtaacgctagctaccgtgacgttgttaccggtaattattacccgattgggaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 756 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGLKQESLIYDFKLDQWGLKRQPGESFHAYMNRVLTSPIWESNDISAYDLTTLGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 757 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggatgaagacctacccggacgtttattacttgagctataccggtaacgctagctaccgtgacgttgttaccggtaattattacccgattgggaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 758 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 759 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaattggtttccggttatggaaggttgggatcacatggacttcattaactttatcggtagcaataccccgggttatttcagcatctacggtttttacaacgacgttgctaatcgtgttcatagcctgccgaaa

SEQ ID NO: 760 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNWFPVMEGWDHMDFINFIGSNTPGYFSIYGFYNDVANRVHSLPK

SEQ ID NO: 761 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtggatgaagacctacccggacgtttattacttgagctataccggtaacgctagttaccgtgacgttgttaccggtaattattacccgattgggaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaattggtttccggttatggaaggttgggatcacatggacttcattaactttatcggtagcaataccccgggttatttcagcatctacggtttttacaacgacgttgctaatcgtgttcatagcctgccgaaa

SEQ ID NO: 762 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTLGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNWFPVMEGWDHMDFINFIGSNTPGYFSIYGFYNDVANRVHSLPK

SEQ ID NO: 763 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcctggctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagttaccgtgacgttgttaccggtaattattacccgattgggaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaattggtttccggttatggaaggttgggatcacatggacttcattaactttatcggtagcaataccccgggttatttcagcatctacggtttttacaacgacgttgctaatcgtgttcatagcctgccgaaa

SEQ ID NO: 764 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLFTLISLRMGRYTRQSPPPVIDRSWLPNDGIVNVVSAKYPFGHPNSPYTGAIKQGVWNWFPVMEGWDHMDFINFIGSNTPGYFSIYGFYNDVANRVHSLPK

SEQ ID NO: 765 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtgggtgaagacctacccggacgtttattacttgagctataccggtaacgctagctaccgtgacgttgttaccggtaattattacccgattgggaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaattggtttccggttatggaaggttgggatcacatggacttcattaactttatcggtagcaataccccgggttatttcagcatctacggtttttacaacgacgttgctaatcgtgttcatagcctgccgaaa

SEQ ID NO: 766 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTLGAQELNQWVKTYPDVYYLSYTGNASYRDVVTGNYYPIGTMHPLFTLISLRMGRYTRQSPPPVIDRSWLPNDGIVNVVSAKYPFGHPNSPYTGAIKQGVWNWFPVMEGWDHMDFINFIGSNTPGYFSIYGFYNDVANRVHSLPK

SEQ ID NO: 767 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcctggctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtgggtgaagacctacccggacgtttattacttgagctataccggtaacgctacttaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatgtttttccggttatggaaggttgggatcacatggacttcattaactttatcggtagcaataccccgggttatttcagcatctacggtttttacaacgacgttgctaatcgtgttcatagcctgccgaaa

SEQ ID NO: 768 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGLKQESLIYDFKLDQWGLKRQPGESFHAYMNRVLTSPIWESNDISAYDLTTLGAQELNQWVKTYPDVYYLSYTGNATYRDVVTGNYYPIGTMHPLFTLISLRMGRYTRQSPPPVIDRSWLPNDGIVNVVSAKYPFGHPNSPYTGAIKQGVWNVFPVMEGWDHMDFINFIGSNTPGYFSIYGFYNDVANRVHSLPK

SEQ ID NO: 769 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaattggtttccggttatggaaggttgggatcacatggacttcattaactttatcggtagcaataccccgggttatttcagcatctacggtttttacaacgacgttgctaatcgtgttcatagcctgccgaaa

SEQ ID NO: 770 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLFTLISLRMGRYTRQSPPPVIDRSWLPNDGIVNVVSAKYPFGHPNSPYTGAIKQGVWNWFPVMEGWDHMDFINFIGSNTPGYFSIYGFYNDVANRVHSLPK

SEQ ID NO: 771 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacgtggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcctggctaccccgcataatggtagcacctttgcggatcaacgtctgattgttagcttcatcaaggactttattatccacctggctgcggctgcgggtcagaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtgggtgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatgtttttccggttatggaaggttgggatcacatggacttcattaactttatcggtagcaataccccgggttatttcagcatctacggtttttacaacgacgttgctaatcgtgttcatagcctgccgaaa

SEQ ID NO: 772 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGQKQESLIYDFKLDQWGLKRQPGESFHAYMNRVLTSPIWESNDISAYDLTTLGAQELNQWVKTYPDVYYLSYTGNASYRDVVTGNYYPIGTMHPLFTLISLRMGRYTRQSPPPVIDRSWLPNDGIVNVVSAKYPFGHPNSPYTGAIKQGVWNVFPVMEGWDHMDFINFIGSNTPGYFSIYGFYNDVANRVHSLPK

SEQ ID NO: 773 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacgtggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcctggctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtgggtgaagacctacccggacgtttattacttgagctataccggtaacgctacttaccgtgacgttgttaccggtaattattacccgattgggaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 774 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGLKQESLIYDFKLDQWGLKRQPGESFHAYMNRVLTSPIWESNDISAYDLTTLGAQELNQWVKTYPDVYYLSYTGNATYRDVVTGNYYPIGTMHPLFTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 775 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacgtctgattgttagcttcatcaaggactttattatccacctggctgcggctgcgggtctgaaacaggagggcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattccgaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 776 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGLKQEGLIYDFKLDQWGLKRQPGESFHAYMNRVLTSPIWESNDISAYDLTTRGAQELNQWVKTYPDVYYLSYTGNASYRDVVTGNYYPIPTMHPLFTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 777 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaattggtttccggttatggaaggttgggatcacatggacttcattaactttatcggtagcaataccccgggttatttcagcatctacggtttttacaacgacgttgctaatcgtgttcatagcctgccgaaa

SEQ ID NO: 778 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLFTLISLRMGRYTRQSPPPVIDRSWLPNDGIVNVVSAKYPFGHPNSPYTGAIKQGVWNWFPVMEGWDHMDFINFIGSNTPGYFSIYGFYNDVANRVHSLPK

SEQ ID NO: 779 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacgtggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggatgaagacctacccggacgtttattacttgagctataccggtaacgctacttaccgtgacgttgttaccggtaattattacccgattgggaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatgtttttccggttatggaaggttgggatcacatggacttcattaactttatcggtagcaataccccgggttatttcagcatctacggtttttacaacgacgttgctaatcgtgttcatagcctgccgaaa

SEQ ID NO: 780 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWMKTYPDVYYLSYTGNATYRDVVTGNYYPIGTMHPLFTLISLRMGRYTRQSPPPVIDRSWLPNDGIVNVVSAKYPFGHPNSPYTGAIKQGVWNVFPVMEGWDHMDFINFIGSNTPGYFSIYGFYNDVANRVHSLPK

SEQ ID NO: 781 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtcagaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtgggtgaagacctacccggacgtttattacttgagctataccggtaacgctacttaccgtgacgttgttaccggtaattattacccgattgggaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatgtttttccggttatggaaggttgggatcacatggacttcattaactttatcggtagcaataccccgggttatttcagcatctacggtttttacaacgacgttgctaatcgtgttcatagcctgccgaaa

SEQ ID NO: 782 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGQKQESLIYDFKLDQWGLKRQPGESFHAYMNRVLTSPIWESNDISAYDLTTLGAQELNQWVKTYPDVYYLSYTGNATYRDVVTGNYYPIGTMHPLFTLISLRMGRYTRQSPPPVIDRSWLPNDGIVNVVSAKYPFGHPNSPYTGAIKQGVWNVFPVMEGWDHMDFINFIGSNTPGYFSIYGFYNDVANRVHSLPK

SEQ ID NO: 783 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacgtggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtgggtgaagacctacccggacgtttattacttgagctataccggtaacgctacttaccgtgacgttgttaccggtaattattacccgattgggaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatgtttttccggttatggaaggttgggatcacatggacttcattaactttatcggtagcaataccccgggttatttcagcatctacggtttttacaacgacgttgctaatcgtgttcatagcctgccgaaa

SEQ ID NO: 784 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTLGAQELNQWVKTYPDVYYLSYTGNATYRDVVTGNYYPIGTMHPLFTLISLRMGRYTRQSPPPVIDRSWLPNDGIVNVVSAKYPFGHPNSPYTGAIKQGVWNVFPVMEGWDHMDFINFIGSNTPGYFSIYGFYNDVANRVHSLPK

SEQ ID NO: 785 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggatgaagacctacccggacgtttattacttgagctataccggtaacgctagttaccgtgacgttgttaccggtaattattacccgattgggaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatgtttttccggttatggaaggttgggatcacatggacttcattaactttatcggtagcaataccccgggttatttcagcatctacggtttttacaacgacgttgctaatcgtgttcatagcctgccgaaa

SEQ ID NO: 786 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNVFPVMEGWDHMDFINFIGSNTPGYFSIYGFYNDVANRVHSLPK

SEQ ID NO: 787 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacgtggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtgggtgaagacctacccggacgtttattacttgagctataccggtaacgctagctaccgtgacgttgttaccggtaattattacccgattgggaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatgtttttccggttatggaaggttgggatcacatggacttcattaactttatcggtagcaataccccgggttatttcagcatctacggtttttacaacgacgttgctaatcgtgttcatagcctgccgaaa

SEQ ID NO: 788 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTLGAQELNQWVKTYPDVYYLSYTGNASYRDVVTGNYYPIGTMHPLFTLISLRMGRYTRQSPPPVIDRSWLPNDGIVNVVSAKYPFGHPNSPYTGAIKQGVWNVFPVMEGWDHMDFINFIGSNTPGYFSIYGFYNDVANRVHSLPK

SEQ ID NO: 789 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcctggctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagttaccgtgacgttgttaccggtaattattacccgattgggaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatgtttttccggttatggaaggttgggatcacatggacttcattaactttatcggtagcaataccccgggttatttcagcatctacggtttttacaacgacgttgctaatcgtgttcatagcctgccgaaa

SEQ ID NO: 790 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLFTLISLRMGRYTRQSPPPVIDRSWLPNDGIVNVVSAKYPFGHPNSPYTGAIKQGVWNVFPVMEGWDHMDFINFIGSNTPGYFSIYGFYNDVANRVHSLPK

SEQ ID NO: 791 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacgtggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtggatgaagacctacccggacgtttattacttgagctataccggtaacgctagttaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatgtttttccggttatggaaggttgggatcacatggacttcattaactttatcggtagcaataccccgggttatttcagcatctacggtttttacaacgacgttgctaatcgtgttcatagcctgccgaaa

SEQ ID NO: 792 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGQKQESLIYDFKLDQWGLKRQPGESFHAYMNRVLTSPIWESNDISAYDLTTLGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNVFPVMEGWDHMDFINFIGSNTPGYFSIYGFYNDVANRVHSLPK

SEQ ID NO: 793 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtggatgaagacctacccggacgtttattacttgagctataccggtaacgctacttaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 794 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTLGAQELNQWMKTYPDVYYLSYTGNATYRDVVTGNYYPIGTMHPLFTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 795 - DNA, 1158 bp, Artificial Sequence
  Variant of triacylglycerol lipase from Bacillus thermoamylovorans
atggagaccagcggtaacgattatccgattgtcctggttcacggtctgggtggttggggtaaaggcgaatttctgggttaccgttactggggtggtctgctggacatcgagggttatttgaaccaaaccggtcatcgtacctacgttgctaccgttggtccggttagcagcaattgggatcgtgcggttgaattgtacgcctacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactatgttcacagcgttaccagcttggctaccccgcataatggtagcacctttgcggatcaacgtctgattgttagcttcatcaaggactttattatccacctggctgcggctgcgggtcaaaaacaggagagcctgatctatgatttcaagctggaccaatggggtttgaaacgtcagccgggtgagagcttccatgcgtacatgaaccgtgttctgaccagcccgatttgggagagcaatgatatcagccagtatgacctgacgaccctgggtgcgcaagagctgaaccagtggatgaagacctacccggacgtttattacttgagctataccggtaacgctagctaccgtgacgttgttaccggtaattattacccgattggtaccatgcacccgctgctgaccttgatctcgctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 796 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYVATVGPVSSNWDRAVELYAYIHGGTVDYGAAHAKEHGHARFGRTYPGIYGQWDETNKIHLIGHSMGGQTSRMLVELLKSGSQKEQEYYSQHPEEGISPLFEGGKNYVHSVTSLATPHNGSTFADQRLIVSFIKDFIIHLAAAAGQKQESLIYDFKLDQWGLKRQPGESFHAYMNRVLTSPIWESNDISQYDLTTLGAQELNQWMKTYPDVYYLSYTGNASYRDVVTGNYYPIGTMHPLLTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 797 - DNA, 1158 bp, Artificial Sequence
  Variant of triacylglycerol lipase from Bacillus thermoamylovorans
atggagaccagcggtaacgattatccgattgttctggttcacggtctgggtggttggggtaaaggcgaatttctgggttaccgttactggggtggtctgctggacatcgagggttatttgaaccaaaccggtcatcgtacctacgttgctaccgttggtccggttagcagcaattgggatcgtgcggttgaattgtacgcctacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtactacctttgcggatcaacgtctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttctgaccagcccgatttgggagagcaatgatatcagccagtatgacctgacgaccctgggtgcgcaagagctgaaccagtggatgaagacctacccggacgtttattacttgagctataccggtaacgctagctaccgtgacgttgttaccggtaattattacccgattggtaccatgcacccgctgctgaccttgatctcgctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 798 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYVATVGPVSSNWDRAVELYAYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGTTFADQRLIVSFIKDFIIHLAAAAGQKQESLIYDFKLDQWGLKRQPGESFHAYMNRVLTSPIWESNDISQYDLTTLGAQELNQWMKTYPDVYYLSYTGNASYRDVVTGNYYPIGTMHPLLTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 799 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtggatgaagacctacccggacgtttattacttgagctataccggtaacgctagttaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaattggtttccggttatggaaggttgggatcacatggacttcattaactttatcggtagcaataccccgggttatttcagcatctacggtttttacaacgacgttgctaatcgtgttcatagcctgccgaaa

SEQ ID NO: 800 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGLKQESLIYDFKLDQWGLKRQPGESFHAYMNRVLTSPIWESNDISAYDLTTLGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNWFPVMEGWDHMDFINFIGSNTPGYFSIYGFYNDVANRVHSLPK

SEQ ID NO: 801 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaattggtttccggttatggaaggttgggatcacatggacttcattaactttatcggtagcaataccccgggttatttcagcatctacggtttttacaacgacgttgctaatcgtgttcatagcctgccgaaa

SEQ ID NO: 802 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGQKQESLIYDFKLDQWGLKRQPGESFHAYMNRVLTSPIWESNDISAYDLTTLGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNWFPVMEGWDHMDFINFIGSNTPGYFSIYGFYNDVANRVHSLPK

SEQ ID NO: 803 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcctggctaccccgcataatggtagcacctttgcggatcaacgtctgattgttagcttcatcaaggactttattatccacctggctgcggctgcgggtcagaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtgggtgaagacctacccggacgtttattacttgagctataccggtaacgctacttaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatgtttttccggttatggaaggttgggatcacatggacttcattaactttatcggtagcaataccccgggttatttcagcatctacggtttttacaacgacgttgctaatcgtgttcatagcctgccgaaa

SEQ ID NO: 804 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGQKQESLIYDFKLDQWGLKRQPGESFHAYMNRVLTSPIWESNDISAYDLTTLGAQELNQWVKTYPDVYYLSYTGNATYRDVVTGNYYPIGTMHPLFTLISLRMGRYTRQSPPPVIDRSWLPNDGIVNVVSAKYPFGHPNSPYTGAIKQGVWNVFPVMEGWDHMDFINFIGSNTPGYFSIYGFYNDVANRVHSLPK

SEQ ID NO: 805 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtcagaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatgtttttccggttatggaaggttgggatcacatggacttcattaactttatcggtagcaataccccgggttatttcagcatctacggtttttacaacgacgttgctaatcgtgttcatagcctgccgaaa

SEQ ID NO: 806 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGQKQESLIYDFKLDQWGLKRQPGESFHAYMNRVLTSPIWESNDISAYDLTTRGAQELNQWVKTYPDVYYLSYTGNASYRDVVTGNYYPIGTMHPLFTLISLRMGRYTRQSPPPVIDRSWLPNDGIVNVVSAKYPFGHPNSPYTGAIKQGVWNVFPVMEGWDHMDFINFIGSNTPGYFSIYGFYNDVANRVHSLPK

SEQ ID NO: 807 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacgtctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttctgaccagcccgatttgggagagcaatgatatcagccagtatgacctgacgaccctgggtgcgcaagagctgaaccagtggatgaagacctacccggacgtttattacttgagctataccggtaacgctagctaccgtgacgttgttaccggtaattattacccgattggtaccatgcacccgctgctgaccttgatcgcgctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 808 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGQKQESLIYDFKLDQWGLKRQPGESFHAYMNRVLTSPIWESNDISQYDLTTLGAQELNQWMKTYPDVYYLSYTGNASYRDVVTGNYYPIGTMHPLLTLIALRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 809 - DNA, 1158 bp, Artificial Sequence
  Variant of triacylglycerol lipase from Bacillus thermoamylovorans
atggagaccagcggtaacgattatccgattgtcctggttcacggtctgggtggttggggtaaaggcgaatttctgggttaccgttactggggtggtctgctggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactatgttcacagcgttaccagcttggctaccccgcataatggtagtacctttgcggatcaacgtctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtggatgaagacctacccggacgtttattacttgagctataccggtaacgctagctaccgtgacgttgttaccggtaattattacccgattggtaccatgcacccggtgctgaccttgatctcgctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 810 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNYVHSVTSLATPHNGSTFADQRLIVSFIKDFIIHLAAAAGQKQESLIYDFKLDQWGLKRQPGESFHAYMNRVLTSPIWESNDISAYDLTTLGAQELNQWMKTYPDVYYLSYTGNASYRDVVTGNYYPIGTMHPVLTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 811 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgagggttatttgaaccaaaccggtcatcgtacctacgttgctaccgttggtccggttagcagcaattgggatcgtgcggttgaattgtacgcctacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtactacctttgcggatcaacgtctgattgttagcttcatcaaggactttattatccacctggctgcggctgcgggtcaaaaacaggagagcctgatctatgatttcaagctggaccaatggggtttgaaacgtcagccgggtgagagcttccatgcgtacatgaaccgtgttctgaccagcccgatttgggagagcaatgatatcagccagtatgacctgacgaccctgggtgcgcaagagctgaaccagtggatgaagacctacccggacgtttattacttgagctataccggtaacgctagctaccgtgacgttgttaccggtaattattacccgattggtaccatgcacccgctgtttaccttgatctcgctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 812 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYVATVGPVSSNWDRAVELYAYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGTTFADQRLIVSFIKDFIIHLAAAAGQKQESLIYDFKLDQWGLKRQPGESFHAYMNRVLTSPIWESNDISQYDLTTLGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 813 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaattcctgggttaccgttactggggtggtctgctggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacgtctgattgttagcttcatcaaggactttatcatcactgccgctgcggctgcgggtcaaaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtggatgaagacctacccggacgtttattacttgagctataccggtaacgctagctaccgtgacgttgttaccggtaattatctgccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 814 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIITAAAAAGQKQESLIYDFKLDQWGLKRQPGESFHAYMNRVLTSPIWESNDISAYDLTTLGAQELNQWMKTYPDVYYLSYTGNASYRDVVTGNYLPIGTMHPLFTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 815 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtcagaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggatgaagacctacccggacgtttattacttgagctataccggtaacgctagttaccgtgacgttgttaccggtaattattacccgattccgaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatgtttttccggttatggaaggttgggatcacatggacttcattaactttatcggtagcaataccccgggttatttcagcatctacggtttttacaacgacgttgctaatcgtgttcatagcctgccgaaa

SEQ ID NO: 816 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGQKQESLIYDFKLDQWGLKRQPGESFHAYMNRVLTSPIWESNDISAYDLTTRGAQELNQWMKTYPDVYYLSYTGNASYRDVVTGNYYPIPTMHPLFTLISLRMGRYTRQSPPPVIDRSWLPNDGIVNVVSAKYPFGHPNSPYTGAIKQGVWNVFPVMEGWDHMDFINFIGSNTPGYFSIYGFYNDVANRVHSLPK

SEQ ID NO: 817 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacgtggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctacttaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 818 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNATYRDVVTGNYYPIGTMHPLFTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 819 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcctggctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggatgaagacctacccggacgtttattacttgagctataccggtaacgctagctaccgtgacgttgttaccggtaattattacccgattgggaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaattggtttccggttatggaaggttgggatcacatggacttcattaactttatcggtagcaataccccgggttatttcagcatctacggtttttacaacgacgttgctaatcgtgttcatagcctgccgaaa

SEQ ID NO: 820 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGLKQESLIYDFKLDQWGLKRQPGESFHAYMNRVLTSPIWESNDISAYDLTTRGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNWFPVMEGWDHMDFINFIGSNTPGYFSIYGFYNDVANRVHSLPK

SEQ ID NO: 821 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtgggtgaagacctacccggacgtttattacttgagctataccggtaacgctagctaccgtgacgttgttaccggtaattattacccgattccgaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 822 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTLGAQELNQWVKTYPDVYYLSYTGNASYRDVVTGNYYPIPTMHPLFTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 823 - DNA, 1158 bp, Artificial Sequence
  Variant of triacylglycerol lipase from Bacillus thermoamylovorans
atggagaccagcggtaacgattatccgattgtcctggttcacggtctgggtggttggggtaaaggcgaatttctgggttaccgttactggggtggtctgctggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtactacctttgcggatcaacgtctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttctgaccagcccgatttgggagagcaatgatatcagccagtatgacctgacgaccctgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 824 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGTTFADQRLIVSFIKDFIIHLAAAAGQKQESLIYDFKLDQWGLKRQPGESFHAYMNRVLTSPIWESNDISQYDLTTLGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 825 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgctggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacgtctgattgttagcttcatcaaggactttatcatccacctggctgcggctgcgggtcaaaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtggatgaagacctacccggacgtttattacttgagctataccggtaacgctagctaccgtgacgttgttaccggtaattatctgccgattggtaccatgcacccgctgtttacgttgattagcctgcgcatgggtcgctacacccgtcaaagcccaccaccggttattgatcgtagctggctgccgaacgacggtattgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 826 - protein, 386 aa, Artificial Sequence
  Variant of triacylglycerol lipase from Bacillus thermoamylovorans
METSGNDYPIVLVHGLGGWGKGEMLGYRYWGGLLDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGQKQESLIYDFKLDQWGLKRQPGESFHAYMNRVLTSPIWESNDISAYDLTTLGAQELNQWMKTYPDVYYLSYTGNASYRDVVTGNYLPIGTMHPLFTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 827 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtgggtgaagacctacccggacgtttattacttgagctataccggtaacgctacttaccgtgacgttgttaccggtaattattacccgattgggaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 828 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTLGAQELNQWVKTYPDVYYLSYTGNATYRDVVTGNYYPIGTMHPLFTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 829 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgagggttatttgaaccaaaccggtcatcgtacctacgtggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtgggtgaagacctacccggacgtttattacttgagctataccggtaacgctagttaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatgtttttccggttatggaaggttgggatcacatggacttcattaactttatcggtagcaataccccgggttatttcagcatctacggtttttacaacgacgttgctaatcgtgttcatagcctgccgaaa

SEQ ID NO: 830 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTLGAQELNQWVKTYPDVYYLSYTGNASYRDVVTGNYYPIGTMHPLFTLISLRMGRYTRQSPPPVIDRSWLPNDGIVNVVSAKYPFGHPNSPYTGAIKQGVWNVFPVMEGWDHMDFINFIGSNTPGYFSIYGFYNDVANRVHSLPK

SEQ ID NO: 831 - DNA, 1158 bp, Artificial Sequence
  Variant of triacylglycerol lipase from Bacillus thermoamylovorans
atggagaccagcggtaacgattatccgattgtcctggttcacggtttcggtggttggggtaaaggcgaatttctgggttaccgttactggggtggtctgctggacatcgagggttatttgaaccaaaccggtcatcgtacctacgttgctaccgttggtccggttagcagcaattgggatcgtgcggttgaattgtacgcctacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagtacctttgcggatcaacgtctgattgttagcttcatcaaggactttattatccacctggctgcggctgcgggtcaaaaacaggagagcctgatctatgatttcaagctggaccaatggggtttgaaacgtcagccgggtgagagcttccatgcgtacatgaaccgtgttctgaccagcccgatttgggagagcaatgatatcagccagtatgacctgacgaccctgggtgcgcaagagctgaaccagtggatgaagacctacccggacgtttattacttgagctataccggtaacgctagctaccgtgacgttgttaccggtaattattacccgattggtaccatgcacccgctgctgaccttgatcgcgctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 832 - protein, 386 aa, Artificial Sequence
  Variant of triacylglycerol lipase from Bacillus thermoamylovorans
METSGNDYPIVLVHGFGGWGKGEFLGYRYWGGLLDIEGYLNQTGHRTYVATVGPVSSNWDRAVELYAYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGQKQESLIYDFKLDQWGLKRQPGESFHAYMNRVLTSPIWESNDISQYDLTTLGAQELNQWMKTYPDVYYLSYTGNASYRDVVTGNYYPIGTMHPLLTLIALRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 833 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtgggtgaagacctacccggacgtttattacttgagctataccggtaacgctagttaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 834 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTLGAQELNQWVKTYPDVYYLSYTGNASYRDVVTGNYYPIGTMHPLFTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 835 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtggatgaagacctacccggacgtttattacttgagctataccggtaacgctagttaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaattggtttccggttatggaaggttgggatcacatggacttcattaactttatcggtagcaataccccgggttatttcagcatctacggtttttacaacgacgttgctaatcgtgttcatagcctgccgaaa

SEQ ID NO: 836 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTLGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNWFPVMEGWDHMDFINFIGSNTPGYFSIYGFYNDVANRVHSLPK

SEQ ID NO: 837 - DNA, 1158 bp, Artificial Sequence
  Variant of triacylglycerol lipase from Bacillus thermoamylovorans
atggagaccagcggtaacgattatccgattgtcctggttcacggtctgggtggttggggtaaaggcgaatttctgggttaccgttactggggtggtctgctggacatcgagggttatttgaaccaaaccggtcatcgtacctacgttgctaccgttggtccggttagcagcaattgggatcgtgcggttgaattgtacgcctacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagtacctttgcggatcaacgtctgattctgagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttctgaccagcccgatttgggagagcaatgatatcagccagtatgacctgacgaccctgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 838 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYVATVGPVSSNWDRAVELYAYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLILSFIKDFIIHLAAAAGQKQESLIYDFKLDQWGLKRQPGESFHAYMNRVLTSPIWESNDISQYDLTTLGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 839 - DNA, 1158 bp, Artificial Sequence
  Variant of triacylglycerol lipase from Bacillus thermoamylovorans
atggagaccagcggtaacgattatccgattgtcctggttcacggtttcggtggttggggtaaaggcgaatttctgggttaccgttactggggtggtctgctggacatcgagggttatttgaaccaaaccggtcatcgtacctacgttgctaccgttggtccggttagcagcaattgggatcgtgcggttgaattgtacgcctacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactatgttcacagcgttaccagcttggctaccccgcataatggtactacctttgcggatcaacgtctgattgttagcttcatcaaggactttattatccacctggctgcggctgcgggtcaaaaacaggagagcctgatctatgatttcaagctggaccaatggggtttgaaacgtcagccgggtgagagcttccatgcgtacatgaaccgtgttctgaccagcccgatttgggagagcaatgatatcagccagtatgacctgtcgaccctgggtgcgcaagagctgaaccagtggatgaagacctacccggacgtttattacttgagctataccggtaacgctagctaccgtgacgttgttaccggtaattattacccgattggtaccatgcacccgctgctgaccttgatctcgctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 840 - protein, 386 aa, Artificial Sequence
  Variant of triacylglycerol lipase from Bacillus thermoamylovorans
METSGNDYPIVLVHGFGGWGKGEFLGYRYWGGLLDIEGYLNQTGHRTYVATVGPVSSNWDRAVELYAYIHGGTVDYGAAHAKEHGHARFGRTYPGIYGQWDETNKIHLIGHSMGGQTSRMLVELLKSGSQKEQEYYSQHPEEGISPLFEGGKNYVHSVTSLATPHNGTTFADQRLIVSFIKDFIIHLAAAAGQKQESLIYDFKLDQWGLKRQPGESFHAYMNRVLTSPIWESNDISQYDLSTLGAQELNQWMKTYPDVYYLSYTGNASYRDVVTGNYYPIGTMHPLLTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 841 - DNA, 1158 bp, Artificial Sequence
  Variant of triacylglycerol lipase from Bacillus thermoamylovorans
atggagaccagcggtaacgattatccgattgtcctggttcacggtctgggtggttggggtaaaggcgaatttctgggttaccgttactggggtggtctgctggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactatgttcacagcgttaccagcttggctaccccgcataatggtagtacctttgcggatcaacgtctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttctgaccagcccgatttgggagagcaatgatatcagccagtatgacctgacgaccctgggtgcgcaagagctgaaccagtggatgaagacctacccggacgtttattacttgagctataccggtaacgctagctaccgtgacgttgttaccggtaattattacccgattggtaccatgcacccggtgctgaccttgatctcgctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 842 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNYVHSVTSLATPHNGSTFADQRLIVSFIKDFIIHLAAAAGQKQESLIYDFKLDQWGLKRQPGESFHAYMNRVLTSPIWESNDISQYDLTTLGAQELNQWMKTYPDVYYLSYTGNASYRDVVTGNYYPIGTMHPVLTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 843 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtcagaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggatgaagacctacccggacgtttattacttgagctataccggtaacgctagttaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 844 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGQKQESLIYDFKLDQWGLKRQPGESFHAYMNRVLTSPIWESNDISAYDLTTRGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 845 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcctggctaccccgcataatggtagcacctttgcggatcaacgtctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggatgaagacctacccggacgtttattacttgagctataccggtaacgctagttaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatgtttttccggttatggaaggttgggatcacatggacttcattaactttatcggtagcaataccccgggttatttcagcatctacggtttttacaacgacgttgctaatcgtgttcatagcctgccgaaa

SEQ ID NO: 846 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGQKQESLIYDFKLDQWGLKRQPGESFHAYMNRVLTSPIWESNDISAYDLTTRGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNVFPVMEGWDHMDFINFIGSNTPGYFSIYGFYNDVANRVHSLPK

SEQ ID NO: 847 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacgtggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcctggctaccccgcataatggtagcacctttgcggatcaacgtctgattgttagcttcatcaaggactttattatccacctggctgcggctgcgggtcagaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtgggtgaagacctacccggacgtttattacttgagctataccggtaacgctacttaccgtgacgttgttaccggtaattattacccgattccgaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatgtttttccggttatggaaggttgggatcacatggacttcattaactttatcggtagcaataccccgggttatttcagcatctacggtttttacaacgacgttgctaatcgtgttcatagcctgccgaaa

SEQ ID NO: 848 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGQKQESLIYDFKLDQWGLKRQPGESFHAYMNRVLTSPIWESNDISAYDLTTLGAQELNQWVKTYPDVYYLSYTGNATYRDVVTGNYYPIPTMHPLFTLISLRMGRYTRQSPPPVIDRSWLPNDGIVNVVSAKYPFGHPNSPYTGAIKQGVWNVFPVMEGWDHMDFINFIGSNTPGYFSIYGFYNDVANRVHSLPK

SEQ ID NO: 849 - DNA, 1158 bp, Artificial Sequence
  Variant of triacylglycerol lipase from Bacillus thermoamylovorans
atggagaccagcggtaacgattatccgattatcctggttcacggtttgggtggttggggtaaaggcgaatttctgggttaccgttactggggtggtctgctggacatcgagggttatttgaaccaaaccggtcatcgtacctacgttgctaccgttggtccggttagcagcaattgggatcgtgcggttgaattgtacgcctacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtactacctttgcggatcaacgtctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtggatgaagacctacccggacgtttattacttgagctataccggtaacgctagctaccgtgacgttgttaccggtaattattacccgattggtaccatgcacccgctgctgaccttgatctcgctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 850 - protein, 386 aa, Artificial Sequence
  Variant of triacylglycerol lipase from Bacillus thermoamylovorans
METSGNDYPIILVHGLGGWGKGEFLGYRYWGGLLDIEGYLNQTGHRTYVATVGPVSSNWDRAVELYAYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGTTFADQRLIVSFIKDFIIHLAAAAGQKQESLIYDFKLDQWGLKRQPGESFHAYMNRVLTSPIWESNDISAYDLTTLGAQELNQWMKTYPDVYYLSYTGNASYRDVVTGNYYPIGTMHPLLTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 851 - DNA, 1158 bp, Artificial Sequence
  Variant of triacylglycerol lipase from Bacillus thermoamylovorans
atggagaccagcggtaacgattatccgattgtcctggttcacggtctgggtggttggggtaaaggcgaatttctgggttaccgttactggggtggtctgctggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagtacctttgcggatcaacgtctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttctgaccagcccgatttgggagagcaatgatatcagccagtatgacctgacgaccctgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 852 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGQKQESLIYDFKLDQWGLKRQPGESFHAYMNRVLTSPIWESNDISQYDLTTLGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 853 - DNA, 1158 bp, Artificial Sequence
  Variant of triacylglycerol lipase from Bacillus thermoamylovorans
atggagaccagcggtaacgattatccgattatcctggttcacggtttcggtggttggggtaaaggcgaatttctgggttaccgttactggggtggtctgctggacatcgagggttatttgaaccaaaccggtcatcgtacctacgttgctaccgttggtccggttagcagcaattgggatcgtgcggttgaattgtacgcctacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtactacctttgcggatcaacgtctgattgtgagcttcgtcaaggactttattatccacctggctgcggctgcgggtcaaaaacaggagagcttgatctatgatttcaagctggaccaatggggtttgaaacgtcagccgggtgagagcttccatgcgtacatgaaccgtgttctgaccagcccgatttgggagagcaatgatatcagcgcctatgacctgaccaccctgggtgcgcaagagctgaaccagtggatgaagacctacccggacgtttattacttgagctataccggtaacgctagctaccgtgacgttgttaccggtaattattacccgattggtaccatgcacccgctgctgaccttgatctcgctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 854 - protein, 386 aa, Artificial Sequence
  Variant of triacylglycerol lipase from Bacillus thermoamylovorans
METSGNDYPIILVHGFGGWGKGEFLGYRYWGGLLDIEGYLNQTGHRTYVATVGPVSSNWDRAVELYAYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGTTFADQRLIVSFVKDFIIHLAAAAGQKQESLIYDFKLDQWGLKRQPGESFHAYMNRVLTSPIWESNDISAYDLTTLGAQELNQWMKTYPDVYYLSYTGNASYRDVVTGNYYPIGTMHPLLTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 855 - DNA, 1158 bp, Artificial Sequence
  Variant of triacylglycerol lipase from Bacillus thermoamylovorans
atggagaccagcggtaacgattatccgattatcctggttcacggtttcggtggttggggtaaaggcgaatttctgggttaccgttactggggtggtctgctggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagtacctttgcggatcaacgtctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttctgaccagcccgatttgggagagcaatgatatcagccagtatgacctgtcgaccctgggtgcgcaagagctgaaccagtggatgaagacctacccggacgtttattacttgagctataccggtaacgctagctaccgtgacgttgttaccggtaattattacccgattggtaccatgcacccgctgctgaccttgatctcgctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 856 - protein, 386 aa, Artificial Sequence
  Variant of triacylglycerol lipase from Bacillus thermoamylovorans
METSGNDYPIILVHGFGGWGKGEFLGYRYWGGLLDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGQKQESLIYDFKLDQWGLKRQPGESFHAYMNRVLTSPIWESNDISQYDLSTLGAQELNQWMKTYPDVYYLSYTGNASYRDVVTGNYYPIGTMHPLLTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 857 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaattggtttccggttatggaaggttgggatcacatggacttcattaactttatcggtagcaataccccgggttatttcagcatctacggtttttacaacgacgttgctaatcgtgttcatagcctgccgaaa

SEQ ID NO: 858 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGQKQESLIYDFKLDQWGLKRQPGESFHAYMNRVLTSPIWESNDISAYDLTTLGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNWFPVMEGWDHMDFINFIGSNTPGYFSIYGFYNDVANRVHSLPK

SEQ ID NO: 859 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgctggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacgtctgattgttagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtggatgaagacctacccggacgtttattacttgagctataccggtaacgctagctaccgtgacgttgttaccggtaattattacccgattccgaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaattggtttccggttatggaaggttgggatcacatggacttcattaactttatcggtagcaataccccgggttatttcagcatctacggtttttacaacgacgttgctaatcgtgttcatagcctgccgaaa

SEQ ID NO: 860 - protein, 386 aa, Artificial Sequence
  Variant of triacylglycerol lipase from Bacillus thermoamylovorans
METSGNDYPIVLVHGLGGWGKGEFLGYRYWGGLLDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGQKQESLIYDFKLDQWGLKRQPGESFHAYMNRVLTSPIWESNDISAYDLTTLGAQELNQWMKTYPDVYYLSYTGNASYRDVVTGNYYPIPTMHPLFTLISLRMGRYTRQSPPPVIDRSWLPNDGIVNVVSAKYPFGHPNSPYTGAIKQGVWNWFPVMEGWDHMDFINFIGSNTPGYFSIYGFYNDVANRVHSLPK

SEQ ID NO: 861 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcctggctaccccgcataatggtagcacctttgcggatcaacgtctgattgttagcttcatcaaggactttattatccacctggctgcggctgcgggtcagaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 862 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGQKQESLIYDFKLDQWGLKRQPGESFHAYMNRVLTSPIWESNDISAYDLTTRGAQELNQWVKTYPDVYYLSYTGNASYRDVVTGNYYPIGTMHPLFTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 863 - DNA, 1158 bp, Artificial Sequence
  Variant of triacylglycerol lipase from Bacillus thermoamylovorans
atggagaccagcggtaacgattatccgattgtcctggttcacggtttcggtggttggggtaaaggcgaatttctgggttaccgttactggggtggtctgctggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtactacctttgcggatcaacgtctgattctgagcttcatcaaggactttattatccacctggctgcggctgcgggtcaaaaacaggagagcttgatctatgatttcaagctggaccaatggggtttgaaacgtcagccgggtgagagcttccatgcgtacatgaaccgtgttctgaccagcccgatttgggagagcaatgatatcagcgcctatgacctgacgaccctgggtgcgcaagagctgaaccagtggatgaagacctacccggacgtttattacttgagctataccggtaacgctagctaccgtgacgttgttaccggtaattattacccgattggtaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 864 - protein, 386 aa, Artificial Sequence
  Variant of triacylglycerol lipase from Bacillus thermoamylovorans
METSGNDYPIVLVHGFGGWGKGEFLGYRYWGGLLDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGTTFADQRLILSFIKDFIIHLAAAAGQKQESLIYDFKLDQWGLKRQPGESFHAYMNRVLTSPIWESNDISAYDLTTLGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 865 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgctggacatcgagggttatttgaaccaaaccggtcatcgtacctacgttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacgtctgattgttagcttcatcaaggactttatcatccacctggctgcggctgcgggtcaaaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccctgggtgcgcaagagctgaaccagtggatgaagacctacccggacgtttattacttgagctataccggtaacgctagctaccgtgacgttgttaccggtaattattacccgattggtaccatgcacccgctgtttacgttgattagcctgcgcatgggtcgctacacccgtcaaagcccaccaccggttattgatcgtagctggctgccgaacgacggtattgttaatgttgttagcgctaagtatccgttcggtcacccgaacagcccgtacactggtgcgattaaacagggtgtttggaatagctttccggttatggaaggttgggatcacatggacttcattaactttatcggtagcaataccccgggttatttcagcatctacggtttttacaacgacgttgctaatcgtgttcatagcctgccgaaa

SEQ ID NO: 866 - protein, 386 aa, Artificial Sequence
  Variant of triacylglycerol lipase from Bacillus thermoamylovorans
METSGNDYPIVLVHGLGGWGKGEMLGYRYWGGLLDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGQKQESLIYDFKLDQWGLKRQPGESFHAYMNRVLTSPIWESNDISAYDLTTLGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 867 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 868 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 869 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgtgagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcatatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaattcgtttccggttatggaaggttgggatcacatggacttcattaactttatcggtagcaataccccgggttatttcagcatctacggtttttacaacgacgttgctaatcgtgttcatagcctgccgaaa

SEQ ID NO: 870 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 871 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgtgagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcatatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 872 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLFTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 873 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggatgaagacctacccggacgtttattacttgagctataccggtaacgctagctaccgtgacgttgttaccggtaattattacccgattccaaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 874 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWMKTYPDVYYLSYTGNASYRDVVTGNYYPIPTMHPLFTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 875 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtacgacctttgcggatcaacgtctgattgtgagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattccaaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 876 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGTTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIPTMHPLFTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 877 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggatgaagacctacccggacgtttattacttgagctataccggtaacgctagctaccgtgacgttgttaccggtaattattacccgattgggaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaattggtttccggttatggaaggttgggatcacatggacttcattaactttatcggtagcaataccccgggttatttcagcatctacggtttttacaacgacgttgctaatcgtgttcatagcctgccgaaa

SEQ ID NO: 878 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWMKTYPDVYYLSYTGNASYRDVVTGNYYPIGTMHPLFTLISLRMGRYTRQSPPPVIDRSWLPNDGIVNVVSAKYPFGHPNSPYTGAIKQGVWNWFPVMEGWDHMDFINFIGSNTPGYFSIYGFYNDVANRVHSLPK

SEQ ID NO: 879 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggttcgacctttgcggatcaacgtctgattgtgagcttcatcaaggactttattatccacctggctgcggctgcgggtctgaaacaggagagcttgatctatgatttcaagctggaccaatggggtttgaaacgtcagtcgggtgagagcttccatgcgtacatgaaccgtgttctgaccagcccgatttgggagagcaatgatatcagcgcatatgacctgaccacccgtggtgcgcaagagctgaaccagtgggtgaagacctacccggacgtttattacttgagctataccggtaacgctagctaccgtgacgttgttaccggtaattatctgccgattgggaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaattcgtttccggttatggaaggttgggatcacatggacttcattaactttatcggtagcaataccccgggttatttcagcatctacggtttttacaacgacgttgctaatcgtgttcatagcctgccgaaa

SEQ ID NO: 880 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQSGESFHAYMNRVLTSPIWESNDISAYDLTTRGAQELNQWVKTYPDVYYLSYTGNASYRDVVTGNYLPIGTMHPLFTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 881 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggttcgacctttgcggatcaacgtctgattgtgagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcatatgacctgaccacccgtggtgcgcaagagctgaaccagtgggtgaagacctacccggacgtttattacttgagctataccggtaacgctagctaccgtgacgttgttaccggtaattatctgccgattgggaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaattggtttccggttatggaaggttgggatcacatggacttcattaactttatcggtagcaataccccgggttatttcagcatctacggtttttacaacgacgttgctaatcgtgttcatagcctgccgaaa

SEQ ID NO: 882 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYLPIGTMHPLFTLISLRMGRYTRQSPPPVIDRSWLPNDGIVNVVSAKYPFGHPNSPYTGAIKQGVWNWFPVMEGWDHMDFINFIGSNTPGYFSIYGFYNDVANRVHSLPK

SEQ ID NO: 883 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgtgagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagccaatatgacctgaccacccgtggtgcgcaagagctgaaccagtggatgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaattcgtttccggttatggaaggttgggatcacatggacttcattaactttatcggtagcaataccccgggttatttcagcatctacggtttttacaacgacgttgctaatcgtgttcatagcctgccgaaa

SEQ ID NO: 884 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISQYDLTTRGAQELNQWMKTYPDVYYLSYTGNASYRDVVTGNYYPIGTMHPLLTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 885 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaagcgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 886 - protein, 386 aa, Artificial Sequence
  Variant of triacylglycerol lipase from Bacillus thermoamylovorans
METSGNDYPIVLVHGLGGWGKGEALGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 887 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatgtctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 888 - protein, 386 aa, Artificial Sequence
  Variant of triacylglycerol lipase from Bacillus thermoamylovorans
METSGNDYPIVLVHGLGGWGKGECLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 889 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaagatctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 890 - protein, 386 aa, Artificial Sequence
  Variant of triacylglycerol lipase from Bacillus thermoamylovorans
METSGNDYPIVLVHGLGGWGKGEDLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 891 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaagagctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 892 - protein, 386 aa, Artificial Sequence
  Variant of triacylglycerol lipase from Bacillus thermoamylovorans
METSGNDYPIVLVHGLGGWGKGEELGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 893 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatttctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 894 - protein, 386 aa, Artificial Sequence
  Variant of triacylglycerol lipase from Bacillus thermoamylovorans
METSGNDYPIVLVHGLGGWGKGEFLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 895 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaggtctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 896 - protein, 386 aa, Artificial Sequence
  Variant of triacylglycerol lipase from Bacillus thermoamylovorans
METSGNDYPIVLVHGLGGWGKGEGLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 897 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaacatctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 898 - protein, 386 aa, Artificial Sequence
  Variant of triacylglycerol lipase from Bacillus thermoamylovorans
METSGNDYPIVLVHGLGGWGKGEHLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 899 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaattctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 900 - protein, 386 aa, Artificial Sequence
  Variant of triacylglycerol lipase from Bacillus thermoamylovorans
METSGNDYPIVLVHGLGGWGKGEILGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 901 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaaagctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 902 - protein, 386 aa, Artificial Sequence
  Variant of triacylglycerol lipase from Bacillus thermoamylovorans
METSGNDYPIVLVHGLGGWGKGEKLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 903 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaacttctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 904 - protein, 386 aa, Artificial Sequence
  Variant of triacylglycerol lipase from Bacillus thermoamylovorans
METSGNDYPIVLVHGLGGWGKGELLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 905 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaaatctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 906 - protein, 386 aa, Artificial Sequence
  Variant of triacylglycerol lipase from Bacillus thermoamylovorans
METSGNDYPIVLVHGLGGWGKGENLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 907 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaacctctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 908 - protein, 386 aa, Artificial Sequence
  Variant of triacylglycerol lipase from Bacillus thermoamylovorans
METSGNDYPIVLVHGLGGWGKGEPLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 909 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaacaactgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 910 - protein, 386 aa, Artificial Sequence
  Variant of triacylglycerol lipase from Bacillus thermoamylovorans
METSGNDYPIVLVHGLGGWGKGEQLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 911 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaaggctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 912 - protein, 386 aa, Artificial Sequence
  Variant of triacylglycerol lipase from Bacillus thermoamylovorans
METSGNDYPIVLVHGLGGWGKGERLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 913 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaagtctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 914 - protein, 386 aa, Artificial Sequence
  Variant of triacylglycerol lipase from Bacillus thermoamylovorans
METSGNDYPIVLVHGLGGWGKGESLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 915 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaacgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 916 - protein, 386 aa, Artificial Sequence
  Variant of triacylglycerol lipase from Bacillus thermoamylovorans
METSGNDYPIVLVHGLGGWGKGETLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 917 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaagtgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 918 - protein, 386 aa, Artificial Sequence
  Variant of triacylglycerol lipase from Bacillus thermoamylovorans
METSGNDYPIVLVHGLGGWGKGEVLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 919 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatggctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 920 - protein, 386 aa, Artificial Sequence
  Variant of triacylglycerol lipase from Bacillus thermoamylovorans
METSGNDYPIVLVHGLGGWGKGEWLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 921 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaatatctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 922 - protein, 386 aa, Artificial Sequence
  Variant of triacylglycerol lipase from Bacillus thermoamylovorans
METSGNDYPIVLVHGLGGWGKGEYLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 923 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgaggcttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 924 - protein, 386 aa, Artificial Sequence
  Variant of triacylglycerol lipase from Bacillus thermoamylovorans
METSGNDYPIVLVHGLGGWGKGEMLGYRYWGGLKDIEAYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 925 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagtgttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 926 - protein, 386 aa, Artificial Sequence
  Variant of triacylglycerol lipase from Bacillus thermoamylovorans
METSGNDYPIVLVHGLGGWGKGEMLGYRYWGGLKDIECYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 927 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgaggattatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 928 - protein, 386 aa, Artificial Sequence
  Variant of triacylglycerol lipase from Bacillus thermoamylovorans
METSGNDYPIVLVHGLGGWGKGEMLGYRYWGGLKDIEDYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 929 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgaggagtatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 930 - protein, 386 aa, Artificial Sequence
  Variant of triacylglycerol lipase from Bacillus thermoamylovorans
METSGNDYPIVLVHGLGGWGKGEMLGYRYWGGLKDIEEYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 931 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagttttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 932 - protein, 386 aa, Artificial Sequence
  Variant of triacylglycerol lipase from Bacillus thermoamylovorans
METSGNDYPIVLVHGLGGWGKGEMLGYRYWGGLKDIEFYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 933 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagcactatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 934 - protein, 386 aa, Artificial Sequence
  Variant of triacylglycerol lipase from Bacillus thermoamylovorans
METSGNDYPIVLVHGLGGWGKGEMLGYRYWGGLKDIEHYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 935 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagatttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 936 - protein, 386 aa, Artificial Sequence
  Variant of triacylglycerol lipase from Bacillus thermoamylovorans
METSGNDYPIVLVHGLGGWGKGEMLGYRYWGGLKDIEIYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 937 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagaagtatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 938 - protein, 386 aa, Artificial Sequence
  Variant of triacylglycerol lipase from Bacillus thermoamylovorans
METSGNDYPIVLVHGLGGWGKGEMLGYRYWGGLKDIEKYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 939 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagctgtatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 940 - protein, 386 aa, Artificial Sequence
  Variant of triacylglycerol lipase from Bacillus thermoamylovorans
METSGNDYPIVLVHGLGGWGKGEMLGYRYWGGLKDIELYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 941 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagatgtatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 942 - protein, 386 aa, Artificial Sequence
  Variant of triacylglycerol lipase from Bacillus thermoamylovorans
METSGNDYPIVLVHGLGGWGKGEMLGYRYWGGLKDIEMYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 943 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagaactatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 944 - protein, 386 aa, Artificial Sequence
  Variant of triacylglycerol lipase from Bacillus thermoamylovorans
METSGNDYPIVLVHGLGGWGKGEMLGYRYWGGLKDIENYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 945 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagccgtatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 946 - protein, 386 aa, Artificial Sequence
  Variant of triacylglycerol lipase from Bacillus thermoamylovorans
METSGNDYPIVLVHGLGGWGKGEMLGYRYWGGLKDIEPYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 947 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagcagtatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 948 - protein, 386 aa, Artificial Sequence
  Variant of triacylglycerol lipase from Bacillus thermoamylovorans
METSGNDYPIVLVHGLGGWGKGEMLGYRYWGGLKDIEQYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 949 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagaggtatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 950 - protein, 386 aa, Artificial Sequence
  Variant of triacylglycerol lipase from Bacillus thermoamylovorans
METSGNDYPIVLVHGLGGWGKGEMLGYRYWGGLKDIERYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 951 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagagttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 952 - protein, 386 aa, Artificial Sequence
  Variant of triacylglycerol lipase from Bacillus thermoamylovorans
METSGNDYPIVLVHGLGGWGKGEMLGYRYWGGLKDIESYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 953 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagacttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 954 - protein, 386 aa, Artificial Sequence
  Variant of triacylglycerol lipase from Bacillus thermoamylovorans
METSGNDYPIVLVHGLGGWGKGEMLGYRYWGGLKDIETYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 955 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgaggtgtatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 956 - protein, 386 aa, Artificial Sequence
  Variant of triacylglycerol lipase from Bacillus thermoamylovorans
METSGNDYPIVLVHGLGGWGKGEMLGYRYWGGLKDIEVYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 957 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagtggtatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 958 - protein, 386 aa, Artificial Sequence
  Variant of triacylglycerol lipase from Bacillus thermoamylovorans
METSGNDYPIVLVHGLGGWGKGEMLGYRYWGGLKDIEWYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 959 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagtattatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 960 - protein, 386 aa, Artificial Sequence
  Variant of triacylglycerol lipase from Bacillus thermoamylovorans
METSGNDYPIVLVHGLGGWGKGEMLGYRYWGGLKDIEYYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 961 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacgcggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 962 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYAATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 963 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctactgtgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 964 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYCATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 965 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacgacgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 966 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYDATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 967 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacgaggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 968 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYEATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 969 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctactttgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 970 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYFATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 971 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacggggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 972 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYGATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 973 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctaccacgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 974 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYHATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 975 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacatcgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 976 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYIATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 977 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacaaggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 978 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYKATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 979 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacctggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 980 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYLATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 981 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacatggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 982 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYMATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 983 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacaatgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 984 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYNATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 985 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacccggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 986 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYPATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 987 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctaccaggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 988 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYQATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 989 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacagggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 990 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYRATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 991 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctactcggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 992 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYSATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 993 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacgtggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 994 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYVATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 995 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctactgggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 996 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYWATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 997 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctactatgctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 998 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYYATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 999 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattgctggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1000 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIAGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1001 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacatttgtggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1002 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYICGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1003 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattgacggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1004 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIDGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1005 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattgagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1006 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIEGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1007 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacatttttggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1008 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIFGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1009 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattgggggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1010 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIGGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1011 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattatcggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1012 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIIGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1013 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattaagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1014 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIKGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1015 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattctgggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1016 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYILGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1017 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattatgggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1018 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIMGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1019 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattaatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1020 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYINGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1021 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattccgggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1022 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIPGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1023 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcagggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1024 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIQGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1025 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcggggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1026 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIRGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1027 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacatttcgggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1028 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYISGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1029 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattacgggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1030 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYITGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1031 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattgtgggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1032 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIVGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1033 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacatttggggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1034 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIWGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1035 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacatttatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1036 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIYGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1037 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgcgggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1038 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFAGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1039 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttctgtggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1040 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFCGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1041 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgatggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1042 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFDGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1043 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttctttggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1044 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFFGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1045 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgggggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1046 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFGGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1047 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttccacggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1048 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFHGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1049 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcattggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1050 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFIGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1051 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaagggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1052 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFKGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1053 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcttgggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1054 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFLGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1055 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcatgggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1056 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFMGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1057 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcaacggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1058 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFNGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1059 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttccctggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1060 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFPGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1061 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttccagggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1062 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFQGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1063 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttccgtggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1064 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFRGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1065 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttctcgggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1066 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFSGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1067 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcacgggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1068 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFTGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1069 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgtaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1070 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFVGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1071 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttctggggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1072 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFWGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1073 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttctatggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1074 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFYGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1075 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcgcggctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1076 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSAATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1077 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagctgtgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1078 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSCATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1079 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcgatgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1080 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSDATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1081 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcgaggctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1082 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSEATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1083 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttcgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1084 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSFATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1085 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcggtgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1086 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSGATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1087 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagccatgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1088 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSHATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1089 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcaaggctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1090 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSKATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1091 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcttggctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1092 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSLATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1093 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcatggctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1094 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSMATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1095 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcaatgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1096 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSNATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1097 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcccggctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1098 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSPATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1099 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagccaggctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1100 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSQATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1101 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagccgggctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1102 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSRATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1103 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagctctgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1104 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSSATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1105 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcactgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1106 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSTATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1107 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcgtggctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1108 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSVATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1109 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagctgggctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1110 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSWATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1111 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagctatgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1112 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSYATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1113 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaagctctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1114 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQALIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1115 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaatgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1116 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQCLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1117 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaagatctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1118 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQDLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1119 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaagagctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1120 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQELIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1121 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaatttctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1122 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQFLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1123 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaaggtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1124 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQGLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1125 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacatctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1126 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQHLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1127 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaaattctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1128 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQILIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1129 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaaaagctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1130 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQKLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1131 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaactgctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1132 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQLLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1133 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaaatgctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1134 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQMLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1135 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaaaatctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1136 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQNLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1137 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacctctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1138 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQPLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1139 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacagctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1140 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQQLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1141 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaaagtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1142 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQSLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1143 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaaacgctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1144 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQTLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1145 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaagtgctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1146 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQVLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1147 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaatggctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1148 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQWLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1149 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaatatctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1150 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQYLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1151 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtgctattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1152 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRAIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1153 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgttgtattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1154 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRCIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1155 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtgatattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1156 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRDIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1157 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtgagattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1158 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQREIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1159 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgttttattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1160 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRFIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1161 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtggtattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1162 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRGIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1163 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtcatattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1164 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRHIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1165 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtattattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1166 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRIIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1167 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtaagattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1168 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRKIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1169 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtatgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1170 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRMIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1171 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtaatattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1172 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRNIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1173 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtcctattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1174 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRPIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1175 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtcagattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1176 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRQIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1177 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtcggattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1178 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRRIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1179 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgttcgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1180 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRSIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1181 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtactattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1182 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRTIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1183 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtgtgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1184 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRVIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1185 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgttggattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1186 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRWIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1187 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgttatattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1188 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRYIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1189 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggcttgtgctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1190 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLACAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1191 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgatgctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1192 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLADAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1193 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgaggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1194 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAEAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1195 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggcttttgctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1196 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAFAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1197 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctggggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1198 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAGAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1199 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctcatgctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1200 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAHAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1201 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctatcgctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1202 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAIAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1203 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctaaggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1204 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAKAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1205 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctctggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1206 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLALAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1207 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctatggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1208 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAMAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1209 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctaacgctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1210 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLANAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1211 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctccggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1212 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAPAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1213 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctcaggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1214 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAQAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1215 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctagggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1216 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLARAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1217 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctagtgctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1218 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLASAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1219 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctacggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1220 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLATAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1221 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgtggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1222 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAVAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1223 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggcttgggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1224 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAWAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1225 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggcttatgctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1226 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAYAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1227 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtgcgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1228 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGAKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1229 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggttgtaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1230 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGCKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1231 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtgataaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1232 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGDKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1233 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtgagaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1234 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGEKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1235 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggttttaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1236 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGFKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1237 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtggtaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1238 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGGKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1239 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtcataaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1240 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGHKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1241 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtattaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1242 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGIKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1243 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtaagaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1244 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGKKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1245 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtatgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1246 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGMKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1247 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtaataaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1248 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGNKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1249 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtccgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1250 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGPKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1251 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtcagaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1252 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGQKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1253 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtcggaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1254 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGRKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1255 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtagtaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1256 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGSKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1257 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtactaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1258 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGTKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1259 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtgttaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1260 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGVKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1261 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggttggaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1262 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGWKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1263 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggttataaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1264 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGYKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1265 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttgcgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1266 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVATSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1267 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgtttgtaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1268 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVCTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1269 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttgataccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1270 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVDTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1271 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttgagaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1272 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVETSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1273 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgtttttaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1274 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVFTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1275 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttgggaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1276 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVGTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1277 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttcacaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1278 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVHTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1279 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttattaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1280 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVITSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1281 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttaaaaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1282 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVKTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1283 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttatgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1284 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVMTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1285 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttaacaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1286 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVNTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1287 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttccgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1288 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVPTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1289 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttcaaaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1290 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVQTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1291 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttaggaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1292 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVRTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1293 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgtttcgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1294 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVSTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1295 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttacgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1296 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVTTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1297 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttgtgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1298 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVVTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1299 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgtttggaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1300 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVWTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1301 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgtttataccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1302 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVYTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1303 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggcgagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1304 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWASNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1305 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttggtgtagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1306 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWCSNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1307 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggatagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1308 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWDSNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1309 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttggtttagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1310 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWFSNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1311 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggggagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1312 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWGSNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1313 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttggcacagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1314 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWHSNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1315 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttggattagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1316 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWISNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1317 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttggaaaagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1318 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWKSNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1319 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttggctgagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1320 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWLSNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1321 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttggatgagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1322 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWMSNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1323 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttggaatagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1324 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWNSNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1325 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttggcctagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1326 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWPSNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1327 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttggcagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1328 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWQSNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1329 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttggaggagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1330 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWRSNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1331 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttggagtagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1332 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWSSNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1333 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttggacgagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1334 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWTSNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1335 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggttagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1336 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWVSNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1337 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttggtggagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1338 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWWSNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1339 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttggtatagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1340 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWYSNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1341 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccgctggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1342 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTAGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1343 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacctgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1344 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTCGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1345 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccgatggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1346 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTDGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1347 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccgagggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1348 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTEGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1349 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccttcggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1350 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTFGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1351 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccgggggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1352 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTGGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1353 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccatggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1354 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTHGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1355 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccattggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1356 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTIGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1357 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccaagggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1358 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTKGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1359 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccttgggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1360 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTLGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1361 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccatgggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1362 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTMGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1363 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccaacggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1364 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTNGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1365 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccccgggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1366 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTPGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1367 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccagggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1368 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTQGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1369 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccagtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1370 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTSGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1371 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccacgggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1372 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTTGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1373 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccaccgtgggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1374 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTVGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1375 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacctggggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1376 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTWGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1377 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacctacggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1378 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTYGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1379 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggcgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1380 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWAKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1381 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggtgcaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1382 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWCKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1383 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggataagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1384 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWDKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1385 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggagaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1386 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWEKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1387 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggtttaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1388 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWFKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1389 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggggaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1390 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWGKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1391 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggcataagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1392 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWHKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1393 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggattaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1394 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWIKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1395 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggaaaaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1396 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWKKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1397 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggcttaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1398 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWLKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1399 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggatgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1400 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWMKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1401 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggaataagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1402 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWNKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1403 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggccgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1404 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWPKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1405 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggcagaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1406 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWQKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1407 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggcggaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1408 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWRKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1409 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggtctaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1410 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWSKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1411 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggactaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1412 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWTKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1413 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggtggaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1414 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWWKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1415 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtggtataagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1416 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWYKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1417 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgcggttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1418 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRAVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1419 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgttgtgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1420 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRCVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1421 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgaggttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1422 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYREVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1423 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgttttgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1424 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRFVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1425 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtggggttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1426 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRGVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1427 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtcatgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1428 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRHVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1429 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtattgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1430 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRIVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1431 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtaaggttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1432 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRKVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1433 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtttggttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1434 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRLVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1435 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtatggttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1436 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRMVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1437 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtaatgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1438 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRNVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1439 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtccggttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1440 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRPVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1441 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtcaggttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1442 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRQVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1443 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtcgggttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1444 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRRVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1445 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgttcggttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1446 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRSVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1447 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtacggttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1448 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRTVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1449 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgttgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1450 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRVVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1451 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgttgggttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1452 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRWVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1453 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgttatgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1454 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRYVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1455 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctggcgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1456 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLATLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1457 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgtgcaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1458 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLCTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1459 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctggataccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1460 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLDTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1461 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctggagaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1462 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLETLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1463 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgtttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1464 - protein, 386 aa, Artificial Sequence; identical to SEQ ID NO: 872
  Variant of triacylglycerol lipase from Bacillus thermoamylovorans

SEQ ID NO: 1465 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctggggaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1466 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLGTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1467 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgcataccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1468 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLHTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1469 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgatcaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1470 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLITLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1471 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgaagaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1472 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLKTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1473 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgatgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1474 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLMTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1475 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgaataccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1476 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLNTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1477 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgccgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1478 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLPTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1479 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgcagaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1480 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLQTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1481 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgaggaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1482 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLRTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1483 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgagtaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1484 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLSTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1485 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgacgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1486 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLTTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1487 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctggttaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1488 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLVTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1489 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgtggaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1490 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLWTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1491 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgtacaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1492 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLYTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1493 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcgcgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1494 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISARMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1495 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagctgtcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1496 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISCRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1497 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcgatcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1498 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISDRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1499 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcgagcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1500 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISERMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1501 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagctttcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1502 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISFRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1503 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcgggcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1504 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISGRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1505 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagccatcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1506 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISHRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1507 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcattcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1508 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISIRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1509 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcaagcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1510 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISKRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1511 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcatgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1512 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISMRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1513 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcaatcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1514 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISNRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1515 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcccacgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1516 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISPRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1517 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagccagcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1518 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISQRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1519 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagccggcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1520 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISRRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1521 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagctctcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1522 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISSRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1523 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcacgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1524 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISTRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1525 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcgtgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1526 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISVRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1527 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagctggcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1528 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISWRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1529 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagctatcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1530 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISYRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1531 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctggctatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1532 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLAMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1533 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgtgtatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1534 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLCMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1535 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctggatatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1536 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLDMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1537 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctggagatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1538 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLEMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1539 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgtttatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1540 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLFMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1541 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctggggatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1542 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLGMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1543 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcatatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1544 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLHMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1545 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgattatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1546 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLIMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1547 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgaagatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1548 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLKMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1549 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgctgatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1550 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLLMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1551 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgatgatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1552 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLMMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1553 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgaatatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1554 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLNMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1555 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgccgatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1556 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLPMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1557 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcagatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1558 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLQMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1559 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgagtatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1560 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLSMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1561 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgacgatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1562 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLTMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1563 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctggttatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1564 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLVMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1565 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgtggatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1566 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLWMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1567 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgtatatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1568 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLYMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1569 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtgcgtacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1570 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGAYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1571 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggttgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1572 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGCYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1573 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtgactacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1574 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGDYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1575 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtgagtacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1576 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGEYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1577 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtttctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1578 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGFYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1579 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtgggtacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1580 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGGYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1581 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcactacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1582 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGHYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1583 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtatctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1584 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGIYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1585 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtaagtacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1586 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGKYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1587 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtctttacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1588 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGLYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1589 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtatgtacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1590 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGMYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1591 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtaactacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1592 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGNYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1593 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtccgtacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1594 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGPYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1595 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcagtacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1596 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGQYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1597 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtagctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1598 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGSYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1599 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtacgtacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1600 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGTYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1601 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtgtgtacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1602 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGVYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1603 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggttggtacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1604 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGWYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1605 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggttactacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1606 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGYYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1607 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccagcgccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1608 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPAPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1609 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccatgtccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1610 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPCPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1611 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccagatccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1612 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPDPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1613 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccagagccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1614 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPEPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1615 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccatttccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1616 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPFPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1617 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaggtccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1618 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPGPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1619 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccacatccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1620 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPHPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1621 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaattccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1622 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPIPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1623 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaaagccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1624 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPKPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1625 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccattgccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1626 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPLPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1627 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaatgccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1628 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPMPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1629 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaaatccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1630 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPNPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1631 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccacagccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1632 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPQPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1633 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaaggccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1634 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPRPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1635 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccatcgccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1636 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPSPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1637 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaacgccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1638 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPTPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1639 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccagttccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1640 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPVPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1641 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccatggccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1642 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPWPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1643 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccatatccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1644 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPYPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1645 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacgcgggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1646 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYAGAIKQGVWNHFPVMEGWDHMDFINFIGSNTPGYFSIYGFYNDVANRVHSLPK

SEQ ID NO: 1647 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtactgtggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1648 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYCGAIKQGVWNHFPVMEGWDHMDFINFIGSNTPGYFSIYGFYNDVANRVHSLPK

SEQ ID NO: 1649 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacgatggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1650 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYDGAIKQGVWNHFPVMEGWDHMDFINFIGSNTPGYFSIYGFYNDVANRVHSLPK

SEQ ID NO: 1651 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacgagggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1652 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYEGAIKQGVWNHFPVMEGWDHMDFINFIGSNTPGYFSIYGFYNDVANRVHSLPK

SEQ ID NO: 1653 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtactttggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1654 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYFGAIKQGVWNHFPVMEGWDHMDFINFIGSNTPGYFSIYGFYNDVANRVHSLPK

SEQ ID NO: 1655 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacgggggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1656 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYGGAIKQGVWNHFPVMEGWDHMDFINFIGSNTPGYFSIYGFYNDVANRVHSLPK

SEQ ID NO: 1657 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtaccatggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1658 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYHGAIKQGVWNHFPVMEGWDHMDFINFIGSNTPGYFSIYGFYNDVANRVHSLPK

SEQ ID NO: 1659 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacattggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1660 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYIGAIKQGVWNHFPVMEGWDHMDFINFIGSNTPGYFSIYGFYNDVANRVHSLPK

SEQ ID NO: 1661 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacaagggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1662 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYKGAIKQGVWNHFPVMEGWDHMDFINFIGSNTPGYFSIYGFYNDVANRVHSLPK

SEQ ID NO: 1663 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacctgggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1664 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYLGAIKQGVWNHFPVMEGWDHMDFINFIGSNTPGYFSIYGFYNDVANRVHSLPK

SEQ ID NO: 1665 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacatgggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1666 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYMGAIKQGVWNHFPVMEGWDHMDFINFIGSNTPGYFSIYGFYNDVANRVHSLPK

SEQ ID NO: 1667 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacaatggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1668 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYNGAIKQGVWNHFPVMEGWDHMDFINFIGSNTPGYFSIYGFYNDVANRVHSLPK

SEQ ID NO: 1669 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtaccctggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1670 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYPGAIKQGVWNHFPVMEGWDHMDFINFIGSNTPGYFSIYGFYNDVANRVHSLPK

SEQ ID NO: 1671 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtaccagggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1672 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYQGAIKQGVWNHFPVMEGWDHMDFINFIGSNTPGYFSIYGFYNDVANRVHSLPK

SEQ ID NO: 1673 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtaccggggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1674 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYRGAIKQGVWNHFPVMEGWDHMDFINFIGSNTPGYFSIYGFYNDVANRVHSLPK

SEQ ID NO: 1675 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtactcgggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1676 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYSGAIKQGVWNHFPVMEGWDHMDFINFIGSNTPGYFSIYGFYNDVANRVHSLPK

SEQ ID NO: 1677 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacgtgggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1678 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYVGAIKQGVWNHFPVMEGWDHMDFINFIGSNTPGYFSIYGFYNDVANRVHSLPK

SEQ ID NO: 1679 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtactggggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1680 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYWGAIKQGVWNHFPVMEGWDHMDFINFIGSNTPGYFSIYGFYNDVANRVHSLPK

SEQ ID NO: 1681 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtactatggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1682 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYYGAIKQGVWNHFPVMEGWDHMDFINFIGSNTPGYFSIYGFYNDVANRVHSLPK

SEQ ID NO: 1683 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatgcttttccggttatggaaggttgggatcacatggacttcattaactttatcggtagcaataccccgggttatttcagcatctacggtttttacaacgacgttgctaatcgtgttcatagcctgccgaaa

SEQ ID NO: 1684 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNAFPVMEGWDHMDFINFIGSNTPGYFSIYGFYNDVANRVHSLPK

SEQ ID NO: 1685 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaattgctttccggttatggaaggttgggatcacatggacttcattaactttatcggtagcaataccccgggttatttcagcatctacggtttttacaacgacgttgctaatcgtgttcatagcctgccgaaa

SEQ ID NO: 1686 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNCFPVMEGWDHMDFINFIGSNTPGYFSIYGFYNDVANRVHSLPK

SEQ ID NO: 1687 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatgattttccggttatggaaggttgggatcacatggacttcattaactttatcggtagcaataccccgggttatttcagcatctacggtttttacaacgacgttgctaatcgtgttcatagcctgccgaaa

SEQ ID NO: 1688 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNDFPVMEGWDHMDFINFIGSNTPGYFSIYGFYNDVANRVHSLPK

SEQ ID NO: 1689 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatgagtttccggttatggaaggttgggatcacatggacttcattaactttatcggtagcaataccccgggttatttcagcatctacggtttttacaacgacgttgctaatcgtgttcatagcctgccgaaa

SEQ ID NO: 1690 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNEFPVMEGWDHMDFINFIGSNTPGYFSIYGFYNDVANRVHSLPK

SEQ ID NO: 1691 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatttttttccggttatggaaggttgggatcacatggacttcattaactttatcggtagcaataccccgggttatttcagcatctacggtttttacaacgacgttgctaatcgtgttcatagcctgccgaaa

SEQ ID NO: 1692 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNFFPVMEGWDHMDFINFIGSNTPGYFSIYGFYNDVANRVHSLPK

SEQ ID NO: 1693 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatgggtttccggttatggaaggttgggatcacatggacttcattaactttatcggtagcaataccccgggttatttcagcatctacggtttttacaacgacgttgctaatcgtgttcatagcctgccgaaa

SEQ ID NO: 1694 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNGFPVMEGWDHMDFINFIGSNTPGYFSIYGFYNDVANRVHSLPK

SEQ ID NO: 1695 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatatctttccggttatggaaggttgggatcacatggacttcattaactttatcggtagcaataccccgggttatttcagcatctacggtttttacaacgacgttgctaatcgtgttcatagcctgccgaaa

SEQ ID NO: 1696 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNIFPVMEGWDHMDFINFIGSNTPGYFSIYGFYNDVANRVHSLPK

SEQ ID NO: 1697 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaataagtttccggttatggaaggttgggatcacatggacttcattaactttatcggtagcaataccccgggttatttcagcatctacggtttttacaacgacgttgctaatcgtgttcatagcctgccgaaa

SEQ ID NO: 1698 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNKFPVMEGWDHMDFINFIGSNTPGYFSIYGFYNDVANRVHSLPK

SEQ ID NO: 1699 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatctttttccggttatggaaggttgggatcacatggacttcattaactttatcggtagcaataccccgggttatttcagcatctacggtttttacaacgacgttgctaatcgtgttcatagcctgccgaaa

SEQ ID NO: 1700 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNLFPVMEGWDHMDFINFIGSNTPGYFSIYGFYNDVANRVHSLPK

SEQ ID NO: 1701 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatatgtttccggttatggaaggttgggatcacatggacttcattaactttatcggtagcaataccccgggttatttcagcatctacggtttttacaacgacgttgctaatcgtgttcatagcctgccgaaa

SEQ ID NO: 1702 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNMFPVMEGWDHMDFINFIGSNTPGYFSIYGFYNDVANRVHSLPK

SEQ ID NO: 1703 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaataattttccggttatggaaggttgggatcacatggacttcattaactttatcggtagcaataccccgggttatttcagcatctacggtttttacaacgacgttgctaatcgtgttcatagcctgccgaaa

SEQ ID NO: 1704 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNNFPVMEGWDHMDFINFIGSNTPGYFSIYGFYNDVANRVHSLPK

SEQ ID NO: 1705 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatccgtttccggttatggaaggttgggatcacatggacttcattaactttatcggtagcaataccccgggttatttcagcatctacggtttttacaacgacgttgctaatcgtgttcatagcctgccgaaa

SEQ ID NO: 1706 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNPFPVMEGWDHMDFINFIGSNTPGYFSIYGFYNDVANRVHSLPK

SEQ ID NO: 1707 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcagtttccggttatggaaggttgggatcacatggacttcattaactttatcggtagcaataccccgggttatttcagcatctacggtttttacaacgacgttgctaatcgtgttcatagcctgccgaaa

SEQ ID NO: 1708 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNQFPVMEGWDHMDFINFIGSNTPGYFSIYGFYNDVANRVHSLPK

SEQ ID NO: 1709 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcgttttccggttatggaaggttgggatcacatggacttcattaactttatcggtagcaataccccgggttatttcagcatctacggtttttacaacgacgttgctaatcgtgttcatagcctgccgaaa

SEQ ID NO: 1710 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNRFPVMEGWDHMDFINFIGSNTPGYFSIYGFYNDVANRVHSLPK

SEQ ID NO: 1711 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaattcgtttccggttatggaaggttgggatcacatggacttcattaactttatcggtagcaataccccgggttatttcagcatctacggtttttacaacgacgttgctaatcgtgttcatagcctgccgaaa

SEQ ID NO: 1712 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNSFPVMEGWDHMDFINFIGSNTPGYFSIYGFYNDVANRVHSLPK

SEQ ID NO: 1713 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatacgtttccggttatggaaggttgggatcacatggacttcattaactttatcggtagcaataccccgggttatttcagcatctacggtttttacaacgacgttgctaatcgtgttcatagcctgccgaaa

SEQ ID NO: 1714 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNTFPVMEGWDHMDFINFIGSNTPGYFSIYGFYNDVANRVHSLPK

SEQ ID NO: 1715 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatgtgtttccggttatggaaggttgggatcacatggacttcattaactttatcggtagcaataccccgggttatttcagcatctacggtttttacaacgacgttgctaatcgtgttcatagcctgccgaaa

SEQ ID NO: 1716 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNVFPVMEGWDHMDFINFIGSNTPGYFSIYGFYNDVANRVHSLPK

SEQ ID NO: 1717 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaattggtttccggttatggaaggttgggatcacatggacttcattaactttatcggtagcaataccccgggttatttcagcatctacggtttttacaacgacgttgctaatcgtgttcatagcctgccgaaa

SEQ ID NO: 1718 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNWFPVMEGWDHMDFINFIGSNTPGYFSIYGFYNDVANRVHSLPK

SEQ ID NO: 1719 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaattattttccggttatggaaggttgggatcacatggacttcattaactttatcggtagcaataccccgggttatttcagcatctacggtttttacaacgacgttgctaatcgtgttcatagcctgccgaaa

SEQ ID NO: 1720 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNYFPVMEGWDHMDFINFIGSNTPGYFSIYGFYNDVANRVHSLPK

SEQ ID NO: 1721 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtgcgtacaacgacgttgctaatcgtgttcatagcctgccgaaa

SEQ ID NO: 1722 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGAYNDVANRVHSLPK

SEQ ID NO: 1723 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggttgttacaacgacgttgctaatcgtgttcatagcctgccgaaa

SEQ ID NO: 1724 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGCYNDVANRVHSLPK

SEQ ID NO: 1725 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtgattacaacgacgttgctaatcgtgttcatagcctgccgaaa

SEQ ID NO: 1726 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGDYNDVANRVHSLPK

SEQ ID NO: 1727 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtgagtacaacgacgttgctaatcgtgttcatagcctgccgaaa

SEQ ID NO: 1728 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGEYNDVANRVHSLPK

SEQ ID NO: 1729 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtgggtacaacgacgttgctaatcgtgttcatagcctgccgaaa

SEQ ID NO: 1730 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGGYNDVANRVHSLPK

SEQ ID NO: 1731 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtcattacaacgacgttgctaatcgtgttcatagcctgccgaaa

SEQ ID NO: 1732 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGHYNDVANRVHSLPK

SEQ ID NO: 1733 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtatttacaacgacgttgctaatcgtgttcatagcctgccgaaa

SEQ ID NO: 1734 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGIYNDVANRVHSLPK

SEQ ID NO: 1735 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtaagtacaacgacgttgctaatcgtgttcatagcctgccgaaa

SEQ ID NO: 1736 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGKYNDVANRVHSLPK

SEQ ID NO: 1737 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttgtacaacgacgttgctaatcgtgttcatagcctgccgaaa

SEQ ID NO: 1738 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGLYNDVANRVHSLPK

SEQ ID NO: 1739 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtatgtacaacgacgttgctaatcgtgttcatagcctgccgaaa

SEQ ID NO: 1740 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGMYNDVANRVHSLPK

SEQ ID NO: 1741 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtaattacaacgacgttgctaatcgtgttcatagcctgccgaaa

SEQ ID NO: 1742 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGNYNDVANRVHSLPK

SEQ ID NO: 1743 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtccgtacaacgacgttgctaatcgtgttcatagcctgccgaaa

SEQ ID NO: 1744 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGPYNDVANRVHSLPK

SEQ ID NO: 1745 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtcaatacaacgacgttgctaatcgtgttcatagcctgccgaaa

SEQ ID NO: 1746 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGQYNDVANRVHSLPK

SEQ ID NO: 1747 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtaggtacaacgacgttgctaatcgtgttcatagcctgccgaaa

SEQ ID NO: 1748 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGRYNDVANRVHSLPK

SEQ ID NO: 1749 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggttcttacaacgacgttgctaatcgtgttcatagcctgccgaaa

SEQ ID NO: 1750 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGSYNDVANRVHSLPK

SEQ ID NO: 1751 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtacttacaacgacgttgctaatcgtgttcatagcctgccgaaa

SEQ ID NO: 1752 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGTYNDVANRVHSLPK

SEQ ID NO: 1753 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtgtttacaacgacgttgctaatcgtgttcatagcctgccgaaa

SEQ ID NO: 1754 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGVYNDVANRVHSLPK

SEQ ID NO: 1755 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggttggtacaacgacgttgctaatcgtgttcatagcctgccgaaa

SEQ ID NO: 1756 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGWYNDVANRVHSLPK

SEQ ID NO: 1757 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggttattacaacgacgttgctaatcgtgttcatagcctgccgaaa

SEQ ID NO: 1758 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGYYNDVANRVHSLPK

SEQ ID NO: 1759 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctggcgaaa

SEQ ID NO: 1760 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLAK

SEQ ID NO: 1761 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgtgtaaa

SEQ ID NO: 1762 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLCK

SEQ ID NO: 1763 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctggataaa

SEQ ID NO: 1764 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLDK

SEQ ID NO: 1765 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctggagaaa

SEQ ID NO: 1766 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLEK

SEQ ID NO: 1767 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgtttaaa

SEQ ID NO: 1768 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLFK

SEQ ID NO: 1769 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgggtaaa

SEQ ID NO: 1770 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLGK

SEQ ID NO: 1771 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgcataaa

SEQ ID NO: 1772 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLHK

SEQ ID NO: 1773 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgattaaa

SEQ ID NO: 1774 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLIK

SEQ ID NO: 1775 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgaagaaa

SEQ ID NO: 1776 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLKK

SEQ ID NO: 1777 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgttgaaa

SEQ ID NO: 1778 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLLK

SEQ ID NO: 1779 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgatgaaa

SEQ ID NO: 1780 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLMK

SEQ ID NO: 1781 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgaataaa

SEQ ID NO: 1782 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLNK

SEQ ID NO: 1783 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgcagaaa

SEQ ID NO: 1784 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLQK

SEQ ID NO: 1785 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgcgtaaa

SEQ ID NO: 1786 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLRK

SEQ ID NO: 1787 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgtcgaaa

SEQ ID NO: 1788 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLSK

SEQ ID NO: 1789 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgacgaaa

SEQ ID NO: 1790 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLTK

SEQ ID NO: 1791 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctggtgaaa

SEQ ID NO: 1792 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLVK

SEQ ID NO: 1793 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgtggaaa

SEQ ID NO: 1794 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLWK

SEQ ID NO: 1795 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgtataaa

SEQ ID NO: 1796 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLYK

What is claimed is:

1. A recombinant lipase comprising an amino acid sequence comprising at least 80% sequence identity to SEQ ID NO: 868, wherein said amino acid sequence comprises at least a substitution at position 149, 161, 174, 175, 189, 225, 271, or 293, or combinations thereof, wherein the positions are relative to SEQ ID NO: 2.

2. The recombinant lipase of claim 1, wherein said amino acid sequence of said recombinant lipase comprises at least a substitution 149A/C/D/E/F/G/H/I/K/L/M/N/P/Q/R/S/V/W/Y, 161A/C/D/E/F/G/H/I/K/M/N/P/Q/S/T/V/W/Y, 174A/C/D/F/G/H/I/K/L/M/N/P/Q/T/V/W/Y, 175A/C/D/E/F/G/H/I/K/L/M/N/P/R/S/T/V/W/Y, 189A/C/D/E/F/G/H/I/K/L/M/N/P/Q/R/T/V/W/Y, 225A/C/D/E/F/G/H/I/K/L/N/P/Q/R/S/T/V/W/Y, 271A/C/D/E/F/H/I/K/L/M/N/P/Q/R/S/T/V/W/Y, 293A/C/D/E/F/G/H/I/K/L/M/N/P/R/S/T/V/W/Y, or combinations thereof, wherein the positions are relative to SEQ ID NO: 2.

3. The recombinant lipase of claim 1, wherein said amino acid sequence of said recombinant lipase comprises at least a substitution at position 149, wherein the substitution is 149A/C/D/E/F/G/H/I/K/L/M/N/P/Q/R/S/V/W/Y.

4. The recombinant lipase of claim 1, wherein said amino acid sequence comprises at least a substitution at position 161, wherein the substitution is 161A/C/D/E/F/G/H/I/K/M/N/P/Q/S/T/V/W/Y.

5. The recombinant lipase of claim 1, wherein said amino acid sequence of said recombinant lipase comprises at least a substitution at position 174, wherein the substitution is 174A/C/D/F/G/H/I/K/L/M/N/P/Q/T/V/W/Y.

6. The recombinant lipase of claim 1, wherein said amino acid sequence of said recombinant lipase comprises at least a substitution at position 175, wherein the substitution is 175A/C/D/E/F/G/H/I/K/L/M/N/P/R/S/T/V/W/Y.

7. The recombinant lipase of claim 1, wherein said amino acid sequence of said recombinant lipase comprises at least a substitution at position 189, wherein the substitution is 189A/C/D/E/F/G/H/I/K/L/M/N/P/Q/R/T/V/W/Y.

8. The recombinant lipase of claim 1, wherein said amino acid sequence of said recombinant lipase comprises at least a substitution at position 225, wherein the substitution is 225A/C/D/E/F/G/H/I/K/L/N/P/Q/R/S/T/V/W/Y.

9. The recombinant lipase of claim 1, wherein said amino acid sequence of said recombinant lipase comprises at least a substitution at position 271, wherein the substitution is 271A/C/D/E/F/H/I/K/L/M/N/P/Q/R/S/T/V/W/Y.

10. The recombinant lipase of claim 1, wherein said amino acid sequence of said recombinant lipase comprises at least a substitution at position 293, wherein the substitution is 293A/C/D/E/F/G/H/I/K/L/M/N/P/R/S/T/V/W/Y.

11. The recombinant lipase of claim 1, wherein said amino acid sequence of said recombinant lipase comprises at least a substitution 149E.

12. The recombinant lipase of claim 1, wherein said amino acid sequence of said recombinant lipase comprises at least a substitution 161I.

13. The recombinant lipase of claim 1, wherein said amino acid sequence of said recombinant lipase comprises at least a substitution 174R.

14. The recombinant lipase of claim 1, wherein said amino acid sequence of said recombinant lipase comprises at least a substitution 175L.

15. The recombinant lipase of claim 1, wherein said amino acid sequence of said recombinant lipase comprises at least a substitution 189A.

16. The recombinant lipase of claim 1, wherein said amino acid sequence of said recombinant lipase comprises at least a substitution 225L.

17. The recombinant lipase of claim 1, wherein said amino acid sequence of said recombinant lipase comprises at least a substitution 271D.

18. The recombinant lipase of claim 1, wherein said amino acid sequence of said recombinant lipase comprises at least a substitution 293R.

19. The recombinant lipase of claim 1, wherein said amino acid sequence of said recombinant lipase comprises at least a substitution 149E, 161I, 174R, 175L, 189A, 225L, 271D, or 293R, or combinations thereof.

20. The recombinant lipase of claim 1, wherein said amino acid sequence of said recombinant lipase comprises SEQ ID NO: 14, 26, 38, 54, 72, 110, 142, 246, 284, 310, 312, 318, 320, 322, 324, 328, 330, 332, 336, 338, 340, 344, 350, 352, 354, 360, 368, 382, 402, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1080, 1082, 1084, 1086, 1088, 1090, 1092, 1094, 1096, 1098, 1100, 1102, 1104, 1106, 1108, 1110, 1112, 1114, 1116, 1118, 1120, 1122, 1124, 1126, 1128, 1130, 1132, 1134, 1136, 1138, 1140, 1142, 1144, 1146, 1148, 1150, 1152, 1154, 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226, 1228, 1230, 1232, 1234, 1236, 1238, 1240, 1242, 1244, 1246, 1248, 1250, 1252, 1254, 1256, 1258, 1260, 1262, 1266, 1268, 1270, 1272, 1274, 1276, 1278, 1280, 1282, 1284, 1286, 1288, 1290, 1292, 1294, 1296, 1298, 1300, 1302, 1304, 1306, 1308, 1310, 1312, 1314, 1316, 1318, 1320, 1322, 1324, 1326, 1328, 1330, 1332, 1334, 1336, 1338, 1340, 1342, 1344, 1346, 1348, 1350, 1352, 1354, 1356, 1358, 1360, 1362, 1364, 1366, 1368, 1370, 1372, 1373/1374, 1376, 1378, 1380, 1382, 1384, 1386, 1388, 1390, 1392, 1394, 1396, 1398, 1400, 1402, 1404, 1406, 1408, 1410, 1412, 1414, 1416, 1418, 1420, 1422, 1424, 1426, 1428, 1430, 1432, 1434, 1436, 1438, 1440, 1442, 1444, 1446, 1448, 1450, 1452, 1454, 1456, 1458, 1460, 1462, 1464, 1466, 1468, 1470, 1472, 1474, 1476, 1478, 1480, 1482, 1484, 1486, 1488, 1490, 1492, 1494, 1496, 1498, 1500, 1502, 1504, 1506, 1508, 1510, 1512, 1514, 1516, 1518, 1520, 1522, 1524, 1526, 1528, 1530, 1532, 1534, 1536, 1538, 1540, 1542, 1544, 1546, 1548, 1550, 1552, 1554, 1556, 1558, 1560, 1562, 1564, 1566, 1568, 1570, 1572, 1574, 1576, 1578, 1580, 1582, 1584, 1586, 1588, 1590, 1592, 1594, 1596, 1598, 1600, 1602, 1604, 1606, 1608, 1610, 1612, 1614, 1616, 1618, 1620, 1622, 1624, 1626, 1628, 1630, 1632, 1634, 1636, 1638, 1640, 1642, 1644, 1646, 1648, 1650, 1652, 1654, 1656, 1658, 1660, 1662, 1664, 1666, 1668, 1670, 1672, 1674, 1676, 1678, 1680, 1682, 1684, 1686, 1688, 1690, 1692, 1694, 1696, 1698, 1700, 1702, 1704, 1706, 1708, 1710, 1712, 1714, 1716, 1718, 1720, 1722, 1724, 1726, 1728, 1730, 1732, 1734, 1736, 1738, 1740, 1742, 1744, 1746, 1748, 1750, 1752, 1754, 1756, 1758, 1760, 1762, 1764, 1766, 1768, 1770, 1772, 1774, 1776, 1778, 1780, 1782, 1784, 1786, 1788, 1790, 1792, 1794, or 1796.

21. The recombinant lipase of claim 1, wherein said amino acid sequence of said recombinant lipase comprises SEQ ID NO: 350, 442, 540, 646, 758, or 868.

22. The recombinant lipase of claim 1, wherein said amino acid sequence of said recombinant lipase comprises at least 85% sequence identity to SEQ ID NO: 868.

23. The recombinant lipase of claim 1, wherein said amino acid sequence of said recombinant lipase comprises at least 90% sequence identity to SEQ ID NO: 868.

24. The recombinant lipase of claim 1, wherein said amino acid sequence of said recombinant lipase comprises at least 95% sequence identity to SEQ ID NO: 868.

25. The recombinant lipase of claim 1, wherein said amino acid sequence of said recombinant lipase comprises at least 98% sequence identity to SEQ ID NO: 868.

26. The recombinant lipase of claim 1, wherein said amino acid sequence of said recombinant lipase comprises at least 99% sequence identity to SEQ ID NO: 868.

27. The recombinant lipase of claim 2, wherein said amino acid sequence of said recombinant lipase comprises at least 85% sequence identity to SEQ ID NO: 868.

28. The recombinant lipase of claim 2, wherein said amino acid sequence of said recombinant lipase comprises at least 90% sequence identity to SEQ ID NO: 868.

29. The recombinant lipase of claim 2, wherein said amino acid sequence of said recombinant lipase comprises at least 95% sequence identity to SEQ ID NO: 868.

30. The recombinant lipase of claim 2, wherein said amino acid sequence of said recombinant lipase comprises at least 98% sequence identity to SEQ ID NO: 868.

31. The recombinant lipase of claim 2, wherein said amino acid sequence comprises at least 99% sequence identity to SEQ ID NO: 868.

32. The recombinant lipase of claim 1, wherein said recombinant lipase is purified.

33. A composition comprising at least one recombinant lipase of claim 1.

34. The composition of claim 33, wherein said composition is a nutritional supplement.

35. A pharmaceutical composition comprising a recombinant lipase of claim 1.

36. The pharmaceutical composition of claim 35, further comprising a pharmaceutically acceptable carrier and/or excipient.

37. The pharmaceutical composition of claim 35, wherein said composition is suitable for parenteral injection or infusion, subcutaneous injection, inhalation, or dermal application to a human.

38. The pharmaceutical composition of claim 35, wherein said composition is suitable for oral administration to a human.

39. The pharmaceutical composition of claim 38, wherein said composition further comprises an enteric coating.

40. A method for treating and/or preventing the symptoms of pancreatic insufficiency in a subject, comprising administering to a subject having pancreatic insufficiency—an effective amount of a recombinant lipase of claim 1.

41. The method of claim 40, wherein said symptoms of pancreatic insufficiency are ameliorated.

42. The method of claim 40, wherein said subject is able to eat a diet that is less restricted in its lipid content than diets required by subjects exhibiting the symptoms of pancreatic insufficiency.

43. The method of claim 40, wherein said subject is an infant or child.

44. The method of claim 40, wherein said subject is an adult or young adult.

45. A method for treating and/or preventing the symptoms of pancreatic insufficiency in a subject, comprising administering to a subject having pancreatic insufficiency—an effective amount of a recombinant lipase of claim 2.

46. A method for treating and/or preventing the symptoms of pancreatic insufficiency in a subject, comprising administering to a subject having pancreatic insufficiency an effective amount of a recombinant lipase of claim 19.

47. A method for treating and/or preventing the symptoms of pancreatic insufficiency in a subject, comprising administering to a subject having pancreatic insufficiency an effective amount of a recombinant lipase of claim 20.

48. A method for treating and/or preventing the symptoms of pancreatic insufficiency in a subject, comprising administering to a subject having pancreatic insufficiency an effective amount of a recombinant lipase of claim 21.

* * * * *